(12) United States Patent
Lazar et al.

(10) Patent No.: US 7,662,925 B2
(45) Date of Patent: *Feb. 16, 2010

(54) OPTIMIZED FC VARIANTS AND METHODS FOR THEIR GENERATION

(75) Inventors: Gregory Alan Lazar, Glendale, CA (US); Arthur J. Chirino, Camarillo, CA (US); Wei Dang, Pasadena, CA (US); John R. Desjarlais, Pasadena, CA (US); Stephen Kohl Doberstein, San Francisco, CA (US); Robert J. Hayes, Radnor, PA (US); Sher Bahadur Karki, Pasadena, CA (US); Omid Vafa, Monrovia, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 11/483,250

(22) Filed: Jul. 7, 2006

(65) Prior Publication Data

US 2007/0003546 A1   Jan. 4, 2007

Related U.S. Application Data

(63) Continuation of application No. 10/822,231, filed on Mar. 26, 2004, which is a continuation-in-part of application No. 10/672,280, filed on Sep. 26, 2003, and a continuation-in-part of application No. 10/379,392, filed on Mar. 3, 2003, now abandoned.

(60) Provisional application No. 60/477,839, filed on Jun. 12, 2003, provisional application No. 60/467,606, filed on May 2, 2003, provisional application No. 60/414,433, filed on Sep. 27, 2002, provisional application No. 60/442,301, filed on Jan. 23, 2003, provisional application No. 60/384,197, filed on May 29, 2002, provisional application No. 60/360,843, filed on Mar. 1, 2002.

(51) Int. Cl.
*C07K 16/00* (2006.01)
*C12P 21/08* (2006.01)
*C07K 1/00* (2006.01)

(52) U.S. Cl. .................. 530/387.1; 530/387.3
(58) Field of Classification Search ........... None
See application file for complete search history.

(56) References Cited

U.S. PATENT DOCUMENTS

| | | |
|---|---|---|
| 4,816,397 A | 3/1989 | Boss et al. |
| 5,225,348 A | 7/1993 | Nagata et al. |
| 5,266,491 A | 11/1993 | Nagata et al. |
| 5,328,987 A | 7/1994 | Maliszewski |
| 5,541,087 A | 7/1996 | Lo et al. |
| 5,576,184 A | 11/1996 | Better et al. |
| 5,623,053 A | 4/1997 | Gastinel et al. |
| 5,624,821 A | 4/1997 | Winter et al. |
| 5,633,162 A | 5/1997 | Keen et al. |
| 5,648,237 A | 7/1997 | Carter |
| 5,648,260 A | 7/1997 | Winter et al. |
| 5,821,337 A | 10/1998 | Carter et al. |
| 5,834,597 A | 11/1998 | Tso et al. |
| 5,885,573 A | 3/1999 | Bluestone et al. |
| 6,030,613 A | 2/2000 | Blumberg et al. |
| 6,086,875 A | 7/2000 | Blumberg et al. |
| 6,121,022 A | 9/2000 | Presta et al. |
| 6,165,745 A | 12/2000 | Ward et al. |
| 6,188,965 B1 | 2/2001 | Mayo et al. |
| 6,194,551 B1 | 2/2001 | Idusogie et al. |
| 6,242,195 B1 | 6/2001 | Idusogie et al. |
| 6,269,312 B1 | 7/2001 | Mayo et al. |
| 6,277,375 B1 | 8/2001 | Ward |
| 6,331,415 B1 | 12/2001 | Cabilly et al. |
| 6,358,733 B1 | 3/2002 | Motwani et al. |
| 6,365,161 B1 | 4/2002 | Deo et al. |
| 6,403,312 B1 | 6/2002 | Dahiyat et al. |
| 6,444,789 B1 | 9/2002 | Luo |
| 6,485,726 B1 | 11/2002 | Blumberg et al. |
| 6,528,624 B1 | 3/2003 | Idusogie et al. |
| 6,538,124 B1 | 3/2003 | Idusogie et al. |
| 6,632,927 B2 | 10/2003 | Adair et al. |
| 6,649,165 B2 | 11/2003 | Schubert |
| 6,708,120 B1 | 3/2004 | Mayo et al. |
| 6,719,971 B1 | 4/2004 | Carter et al. |
| 6,737,056 B1 | 5/2004 | Presta |
| 6,792,356 B2 | 9/2004 | Mayo et al. |
| 6,797,492 B2 | 9/2004 | Daugherty et al. |
| 6,801,861 B2 | 10/2004 | Mayo et al. |
| 6,804,611 B2 | 10/2004 | Mayo et al. |
| 6,821,505 B2 | 11/2004 | Ward |
| 6,933,368 B2 | 8/2005 | Co et al. |
| 6,946,292 B2 | 9/2005 | Kanda et al. |
| 6,950,754 B2 | 9/2005 | Mayo et al. |
| 6,982,321 B2 | 1/2006 | Winter |
| 6,992,234 B2 | 1/2006 | Roopenian |
| 2001/0036459 A1 | 11/2001 | Ravetch |
| 2002/0004587 A1 | 1/2002 | Miller et al. |
| 2002/0048772 A1 | 4/2002 | Dahiyat et al. |
| 2002/0062010 A1 | 5/2002 | Arathoon et al. |
| 2002/0090648 A1 | 7/2002 | Dahiyat et al. |

(Continued)

FOREIGN PATENT DOCUMENTS

EP   0 268 636 B1   1/1997

(Continued)

OTHER PUBLICATIONS

Lazar et al. PNAS 2006. 103:4005-4010.*

(Continued)

*Primary Examiner*—Maher M Haddad
*Assistant Examiner*—Chun Dahle
(74) *Attorney, Agent, or Firm*—Morgan Lewis & Bockius LLP; Robin M. Silva, Esq.; David C. Foster, Esq.

(57) ABSTRACT

The present invention relates to optimized Fc variants, methods for their generation, and antibodies and Fc fusions comprising optimized Fc variants.

15 Claims, 32 Drawing Sheets

U.S. PATENT DOCUMENTS

| | | |
|---|---|---|
| 2002/0142374 A1 | 10/2002 | Gallo et al. |
| 2002/0155537 A1 | 10/2002 | Carter et al. |
| 2002/0164328 A1 | 11/2002 | Shinkawa et al. |
| 2002/0192222 A1 | 12/2002 | Blumberg et al. |
| 2003/0012789 A1 | 1/2003 | Blumberg et al. |
| 2003/0049654 A1 | 3/2003 | Dahiyat et al. |
| 2003/0078385 A1 | 4/2003 | Arathoon et al. |
| 2003/0105294 A1 | 6/2003 | Gillies et al. |
| 2003/0108548 A1 | 6/2003 | Bluestone et al. |
| 2003/0118592 A1 | 6/2003 | Ledbetter et al. |
| 2003/0130827 A1 | 7/2003 | Bentzien et al. |
| 2003/0133939 A1 | 7/2003 | Ledbetter et al. |
| 2003/0143682 A1 | 7/2003 | Nicolaides et al. |
| 2003/0157108 A1 | 8/2003 | Presta |
| 2003/0158289 A1 | 8/2003 | Rusin et al. |
| 2003/0158389 A1 | 8/2003 | Idusogie et al. |
| 2003/0166868 A1 | 9/2003 | Presta et al. |
| 2003/0175884 A1 | 9/2003 | Umana et al. |
| 2003/0190311 A1 | 10/2003 | Dall'Acqua et al. |
| 2003/0208054 A1 | 11/2003 | Olsen et al. |
| 2003/0224397 A1 | 12/2003 | Lowman et al. |
| 2003/0229208 A1 | 12/2003 | Queen et al. |
| 2003/0235536 A1 | 12/2003 | Blumberg et al. |
| 2004/0002587 A1 | 1/2004 | Watkins et al. |
| 2004/0043429 A1 | 3/2004 | Dahiyat et al. |
| 2004/0043430 A1 | 3/2004 | Dahiyat et al. |
| 2004/0062763 A1 | 4/2004 | Mosser et al. |
| 2004/0185045 A1 | 9/2004 | Koenig et al. |
| 2004/0191244 A1 | 9/2004 | Presta |
| 2004/0191256 A1 | 9/2004 | Raju |
| 2004/0192897 A2 | 9/2004 | Winter |
| 2004/0228856 A1 | 11/2004 | Presta |
| 2004/0258677 A1 | 12/2004 | Waldmann et al. |
| 2004/0258682 A1 | 12/2004 | Leung et al. |
| 2004/0259150 A1 | 12/2004 | Nakamura et al. |
| 2005/0014934 A1 | 1/2005 | Hinton et al. |
| 2005/0031626 A1 | 2/2005 | Stevenson |
| 2005/0032114 A1 | 2/2005 | Hinton et al. |
| 2005/0033029 A1 | 2/2005 | Lu |
| 2005/0037000 A1 | 2/2005 | Stavenhagen et al. |
| 2005/0037002 A1 | 2/2005 | Velardi et al. |
| 2005/0038610 A1 | 2/2005 | Mayo et al. |
| 2005/0054046 A1 | 3/2005 | Presta et al. |
| 2005/0064514 A1 | 3/2005 | Stavenhagen et al. |
| 2005/0118174 A1 | 6/2005 | Presta |
| 2005/0152894 A1 | 7/2005 | Krummen et al. |
| 2005/0175614 A1 | 8/2005 | Ledbetter et al. |
| 2005/0202023 A1 | 9/2005 | Ledbetter et al. |
| 2005/0202028 A1 | 9/2005 | Ledbetter et al. |
| 2005/0202534 A1 | 9/2005 | Ledbetter et al. |
| 2005/0215767 A1 | 9/2005 | Koenig et al. |
| 2005/0226864 A1 | 10/2005 | Hinton et al. |
| 2005/0233382 A1 | 10/2005 | Presta |
| 2005/0272128 A1 | 12/2005 | Umana et al. |
| 2005/0276799 A1 | 12/2005 | Hinton et al. |
| 2006/0019316 A1 | 1/2006 | Mayo et al. |

FOREIGN PATENT DOCUMENTS

| | | |
|---|---|---|
| EP | 1 176 195 A1 | 1/2002 |
| EP | 1 229 125 A1 | 8/2002 |
| EP | 1 255 209 | 11/2002 |
| EP | 1 255 826 B1 | 11/2002 |
| EP | 0 753 065 B1 | 5/2003 |
| EP | 0 805 628 B1 | 5/2003 |
| EP | 1 323 346 A2 | 11/2003 |
| EP | 1 323 346 A3 | 11/2003 |
| EP | 0 888 125 B1 | 5/2004 |
| EP | 0 904 107 B1 | 10/2004 |
| EP | 0 383 799 B2 | 2/2005 |
| WO | WO 88/07089 A1 | 9/1988 |
| WO | WO 91/06305 A1 | 5/1991 |
| WO | WO 91/19515 A1 | 12/1991 |
| WO | WO 92/04053 A1 | 3/1992 |
| WO | WO 92/16562 A1 | 10/1992 |
| WO | WO 92/22324 A1 | 12/1992 |
| WO | WO 94/29351 A2 | 12/1994 |
| WO | WO 94/29351 A3 | 12/1994 |
| WO | WO 95/05468 A1 | 2/1995 |
| WO | WO 97/28267 A1 | 8/1997 |
| WO | WO 97/34631 A1 | 9/1997 |
| WO | WO 98/02462 A1 | 1/1998 |
| WO | WO 98/05787 A1 | 2/1998 |
| WO | WO 98/23289 A1 | 6/1998 |
| WO | WO 96/22024 A1 | 7/1998 |
| WO | WO 98/47089 A1 | 11/1998 |
| WO | WO 99/04813 A1 | 2/1999 |
| WO | WO 99/51642 A1 | 10/1999 |
| WO | WO 99/54342 A1 | 10/1999 |
| WO | WO 99/58572 A1 | 11/1999 |
| WO | WO 00/09560 A2 | 2/2000 |
| WO | WO 00/09560 A3 | 2/2000 |
| WO | WO 00/24782 A2 | 5/2000 |
| WO | WO 00/24782 A3 | 5/2000 |
| WO | WO 00/42072 A2 | 7/2000 |
| WO | WO 00/42072 A3 | 7/2000 |
| WO | WO 00/61739 A1 | 10/2000 |
| WO | WO 01/29246 A1 | 4/2001 |
| WO | WO 01/38490 A2 | 5/2001 |
| WO | WO 00/23564 A2 | 8/2001 |
| WO | WO 00/23564 A3 | 8/2001 |
| WO | WO 01/57088 A1 | 8/2001 |
| WO | WO 01/59066 A2 | 8/2001 |
| WO | WO 01/59066 A3 | 8/2001 |
| WO | WO 02/30954 A1 | 4/2002 |
| WO | WO 02/31140 A1 | 4/2002 |
| WO | WO 02/44215 A2 | 6/2002 |
| WO | WO 02/060919 A2 | 8/2002 |
| WO | WO 02/060919 A3 | 8/2002 |
| WO | WO 02/061090 A3 | 8/2002 |
| WO | WO 02/061093 A1 | 8/2002 |
| WO | WO 03/014325 A2 | 2/2003 |
| WO | WO 03/014325 A3 | 2/2003 |
| WO | WO 03/016470 A2 | 2/2003 |
| WO | WO 03/035835 A2 | 5/2003 |
| WO | WO 03/035835 A3 | 5/2003 |
| WO | WO 03/054213 A2 | 7/2003 |
| WO | WO 03/059282 A | 7/2003 |
| WO | WO 03/089624 A2 | 10/2003 |
| WO | WO 2004/004662 A2 | 1/2004 |
| WO | WO 2004/004798 A2 | 1/2004 |
| WO | WO 2004/004798 A3 | 1/2004 |
| WO | WO 2004/016750 A3 | 2/2004 |
| WO | WO 2004/022717 A2 | 3/2004 |
| WO | WO 2004/022717 A3 | 3/2004 |
| WO | WO 2004/024871 A2 | 3/2004 |
| WO | WO 2004/024889 A2 | 3/2004 |
| WO | WO 2004/029207 A | 4/2004 |
| WO | WO 2004/035752 A2 | 4/2004 |
| WO | WO 2004/056312 A2 | 7/2004 |
| WO | WO 2004/063351 A2 | 7/2004 |
| WO | WO 2004/063351 A3 | 7/2004 |
| WO | WO 2004/074455 A2 | 9/2004 |
| WO | WO 2004/074455 A3 | 9/2004 |
| WO | WO 2004/092219 A2 | 10/2004 |
| WO | WO 2004/103404 A2 | 12/2004 |
| WO | WO 2004/110472 A2 | 12/2004 |
| WO | WO 2005/000899 A2 | 1/2005 |
| WO | WO 2005/001025 A2 | 1/2005 |
| WO | WO 2005/007809 A2 | 1/2005 |
| WO | WO 2005/011376 A2 | 2/2005 |
| WO | WO 2005/012877 A2 | 2/2005 |
| WO | WO 2005/013090 A2 | 2/2005 |
| WO | WO 2005/018572 A2 | 3/2005 |

| WO | WO 2005/023866 A2 | 3/2005 |
|---|---|---|
| WO | WO 2005/027966 A2 | 3/2005 |
| WO | WO 2005/037867 A1 | 4/2005 |
| WO | WO 2005/040217 A2 | 5/2005 |
| WO | WO 2005/047327 A2 | 5/2005 |
| WO | WO 2005/056606 A | 6/2005 |
| WO | WO 2005/056759 A | 6/2005 |
| WO | WO 2005/060642 A2 | 7/2005 |
| WO | WO 2005/063815 A2 | 7/2005 |
| WO | WO 2005/070963 A1 | 8/2005 |
| WO | WO 2005/116078 A1 | 12/2005 |
| WO | WO 2005/123780 A2 | 12/2005 |
| WO | WO 2006/012500 A2 | 2/2006 |

OTHER PUBLICATIONS

Jefferis. Expert Opin. Biol. Ther. 2007 7(9):1401-1413.*
Kilmartin et al. The Journal of Cell Biology. 1982 93:576-582.*
Algre, et al., "A non-activating "humanized" anti-CD3 monoclonal antibody retains immunosuppressive properties in vivo," *Transplantation*, 57:1537-1543(1994).
Armour, et al., "Recombinant human IgG molecules lacking Fcgamma receptor I binding and monocyte triggering activities," *Eur J Immuno*, 29:2613-2624 (1999).
Ashkenazi, et al., "Immunoadhesins as research tools and therapeutic agents," *Curr Opin Immunol*, 9:195-200 (1997).
Chamow, et al., "Immunoadhesins: principles and applications," *Trends Biotechnol*, 14:52-60 (1996).
Davies, et al. "Expression of GnTIII In a recombinant anti-CD20 CHO production cell line: Expression of antibodies with altered glycoforms leads to an increase in ADCC through higher affinity for FC gamma RIII," *Biotechnol Bioeng*, 74:288-294 (2001).
Hutchins, et al., "Improved blodistribution, tumor targeting, and reduced immunogenicity in mice with a gamma 4 variant of Campath-1H," *PNAS USA*, 92:11980-11984 (1995).
Jefferies, et al., *Immuno Lett*, 54:101-104 (1996).
Krapp, et al., "Structural analysis of human IgG-Fc glycoforms reveals a correlation between glycosylation and structural integrity," *J Mol Biol*, 325:979-989(2003).
Lehrnbecher, et al., "Variant Genotypes of the Low-Affinity Fcγ Receptors in Two Control Populations and a Review of Low-Affinity Fcγ Receptor Polymorphisms in Control and Disease Populations," *Blood*, 94:4220-4232 (1999).
Lund, et al., "Human Fc gamma RI and Fc gamma RII interact with distinct but overlapping sites on human IgG," *J Immunol*, 1447:2657-2662 (1991).
Lund, et al., "Multiple binding sites on the CH2 domain of IgG for mouse Fc gamma R11," *Mol Immunol*, 29:53-59 (1992).
Lund, et al., "Multiple interactions of IgG with its core oligosaccharide can modulate recognition by complement and human Fc gamma receptor I and influence the synthesis of its oligosaccharide chains," *J Immunol*, 154:4963-4969 (1996).
Lund, et al., "Oligosaccharide-protein interactions in IgG can modulate recognition by Fc gamma receptors," *Faseb J*, 9:115-119(1995).
White, et al., "Antibody-targeted immunotherapy for treatment of malignancy," *Annu Rev Med*, 52:125-145 (2001).
Aase, A. et al. "The extended hinge region of IgG3 is not required for high phogocylic capacity mediated by Fc gamma receptors, but the heavy chains must be disulfide bonded," *Eur J Immunol.*, 23(7):1546-1551 (Jul. 1993).
Abadeh, S., et al., "Remodelling the oligosaccharide of human IgG antibodies: effects on biological activities," *Biochem Soc Trans.*, 25(4):S661 (Nov. 1997).
Akewanlop, C., et al., "Phagocytosis of Breast Cancer Cells Mediated by Anti-*MUC* -1 Monoclonal antibody, DF3, and Its Bispecific Antibody" *Cancer Research*, 61:4061-4065 (May 15, 2001).
Alegre, M., et al., "Effect of a Single Amino Acid Mutation on the Activating and Immunosuppressive Properties of a "Humanised" OXT3 Monoclonal Antibody," *J. Immunology*, 148:3461-3468 (Jun. 1992).
Amigorena, S., et al., "Fc receptors for IgG and antigen presentation on MHC class I and class II molecules" *Immunology*, 11:385-390(1999).

Armour, K. L., et al., "Differential binding to human FcγRIIa and FcγRIIb receptors by human IgG wildtype and mutant antibodies," *Molecular Immunology*, 40:585-593 (2003).
Ashkenazi, A., et al., "Mapping the CD4 binding site for human immunodeficiency virus by alanine-scanning mutagenesis," *PNAS, USA*, 87:7150-7154 (Sep. 1990).
Bolland, S. "A Newly Discovered Fc Receptor tha Explains IgG-Isotype Disparities in Effector Responses," *J. Immunity*, 23:2-4 (Jul. 2005).
Boruchov, A. M., et al., "Activating and Inhibitory IgG Fc receptors on human DCs mediate opposing functions" *J. Clin. Invest.* doi:10.1172/JCI24772 (Sep. 16, 2005).
Bowles, J. A., et al., "CD16 polymorphisms and NK activation induced by monoclonal antibody-coated target cells," *Journal of Immunological Methods*, pp. 1-12 (2005).
Brekke, O. H., et al., "Human IgG isotype-specific amino acid residues affecting complement-mediated cell lysis and phogocytosis," *Eur J. Immunl.*, 24(10):2542-5247 (Oct. 1994).
Brekke, O. H., et al., "Human IgG3 can adopt the disulfide bond pattern characteristic for IgG1 without resembling it in complement mediated cell lysis" *Mol. Immunol.* 30(16):1419-1425 (Nov. 1993).
Bruggeman, M., et al., "Comparison of the Effector Functions of Human Immunoglobulins Using A Matched Set of Chimeric Antibodies," *J. Exp. Med.*, 166:1351-1361 (Nov. 1987).
Bruggemann, M., et al., "A matched set of rat/mouse chimeric antibodies. Identification and biological properties of rat H chain constant regions mu, gamma 1, gamma 2a, gamma 2b, gamma 2c, epsilon, and alpha," *J. Immunol.*, 142(9):3145-3150 (May 1989).
Burmeister, W. P., et al., "Crystal structure of the complex of rat neonatal Fc receptor with Fc" *Nature*, 372:379-383 (Nov. 24, 1994).
Canfield, S. M., et al., "The Binding Affinity of Human IgG for its High Affinity Fc Receptor Is Determined by Multiple Amino Acids in the $C_H2$ Domain and Is Modulated by the Hinge Region," *J. Exp. Med.*, 173:1483-1491 (Jun. 1991).
Caron, P. C., et al., "Engineered Humanized Dimeric Forms of IgG Are More Effective Antibodies," *J. Exp. Med.*, 176:1191-1195 (Oct. 1992).
Caron, P. C., et al., "Murine and humanized constructs of monoclonal antibody M19 (anti-CD33) for the therapy of acute myelogenous leukemia," *Cancer*, 73(3 Supp):1049-1056 (Feb. 1994).
Carpenter, P.A., et al., "Non-Fc Receptor-Binding Humanized Anti-CD3 Antibodies Induce Apoptosis of Activated Human T Cells," *Journal of Immunology*, 165:6205-6213 (2000).
Carter, P., et al., "Humanization of an anti-p185$^{HER2}$ antibody for human cancer therapy" *PNAS*, 89:4285-4289 (May 1992).
Cartron, G., et al., "Therapeutic activity of humanized anit-Cd20 monoclonal antibody and polymorphism in IgG Fc receptor FcY RIIIa gene," *Blood*, 99(3):754-758 (Feb. 1, 2002).
Chapman, P. B., "T-Cell Chauvinists Versus Antibody Advocates-Can't We All Just Get Along?" *J. Clin. Oncology*, 22(22):4446-4448 (Nov. 15, 2004).
Chappel, M. S., et al., "Identification of a Secondary Fcγ RI Binding Site within a Genetically Engineered Human IgG Actibody," *J. Biol. Chem.*, 268(33):25124-25131 (Nov. 1993).
Chappel, M. S., et al., "Identification of the Fcγ receptor class I binding site in human IgG through the use of recombinant IgG1/IgG2 hybrid and point-mutated antibodies," *PNAS, USA*, 88:9036-9040 (Oct. 1991).
Chintalacharuvu, K. R., et al., "Hybrid IgA2/IgG1 Antibodies with Tailor-Made Effector Functions," *Clinical Immunology*, 101(1):21-31- (Oct. 2001).
Clark, M. R., "Chemical Immunology Antibody Engineering IgG Effector Mechanisms," Dissertation submitted to Immunology Division of Department of Pathology at Cambridge University, UK (No Date).
Clynes, R. A., et al., "Inhibitory Fc receptors modulate in vivo cytoxicity against tumor targets," *Nature Medicine*, 6(4):443-446 (Apr. 2000).
Clynes, R. et al., "Modulation of Immune complex-induced Inflammation In Vivo by the Coordinate Expression of Activation and Inhibitory Fc Receptors," *J. Exp. Med.*, 189(1):179-185 (Jan. 4, 1999).

Clynes, R., "Immune complexes as therapy for autoimmunity" *J. Clin. Invest.*, 115:25-27 (2005).

Clynes, R., et al., "Fc receptors are required in passive and active immunity to melanoma," *PNAS USA*, 95:652-656 (Jan. 1998).

Cohen-Sodal, J. FG., et al., "Review: Fc γ receptors" *Immunology Letts*, 92:199-205(2004).

Cole, M. S., et al., "Human IgG2 variants of chimeric anti-CD3 are nonmitogenic to T cells," *J. Immunol.*, 159(7):3613-3621 (Oct. 1, 1997).

Coloma, M. J., et al., "The hinge as a spacer contributes to convalent assembly and is required for function of IgG," *J. Immunol.*, 158(2):733-740 (Jan. 15, 1997).

D'Uscio, C. H., et al., "Cellular cytotoxicity mediated by isotype-switch variants of a monoclonal antibody to human neuroblastoma," *Br. J. Cancer*, 64(3):445-450 (Sep. 1991).

Da Silveira, S. A. et al., "Complement Activation Selectively Potentiates the Pathogenicity of the IgG2 b and IgG3 Isotypes of a High Affinity Anti-Erythrocyte Autoantibody," *J. Exp. Med.*, 195(6):665-672 (Mar. 18, 2002).

Dall'Acqua, D. F., et al., "Increasing the Affinity of a Human IgG1 for the Neonatal Fc Receptor: Biological Consequences," *Journal of Immunology*, 169:5171-5180 (2002).

Davis, R. S., et al., "Fc receptor homologs: newest members of a remarkably diverse Fc receptor gene family," *Imm. Revs*, 190:123-136 (2002).

Davis, R. S., et al., "Identification of a family of Fc receptor homologs with preferential B cell expression," *PNAS, USA*, 98(17):9772-9777 (Aug. 2001).

Delano, W. L., et al., "Convergent Solutions to Binding at a Protein-Protein Interface" *Science*, 287:1279-1283 (Feb. 18, 2000).

Dhodapkar, K.M., et al., "Antitumor Monoclonal Antibodies Enhance Cross-Presentation of Cellular Antigens and the Generation of Myeloma-specific Killer T-Cells by Dendritic Cells" *J. Exp Med.*, 195(1):125-133 (Jan. 7, 2002).

Dhodapkar, K.M., et al., "Recruiting dendritic cells to improve antibody therapy of cancer" *PNAS*, 102(18):6243-6244 (May 3, 2005).

Dhodapkar, K.M., et al., "Selective blockade of inhibitory Fcγ receptor enables human dendritic cell maturation with IL-12p70 production and immunity to antibody-coated tumor cells" *PNAS*, 102(8):2910-2915 (Feb. 22, 2005).

Dhodapkar, M. V., et al., "T cells from the tumor microenvironment of patients with progressive myeloma can generate strong, tumor-specific cytolytic responses to autologous, tumor-loaded dendritic cells" *PNAS*, 99(20):13009-13013 (Oct. 1, 2002).

Duncan, A. R., et al., "Localization of the binding site for the human high-affinity Fc receptor on IgG," *Nature*, 332:563-564 (Apr. 7,1988).

Duncan, A. R., et al., "The binding site for C1q on IgG," *Nature* 332:738-740 (Apr. 21, 1988).

Edelman, G. M., et al., "The Covalent Structure of an Entire γG Immunoglobulin Molecule," *PNAS*, 63:78-85 (1969).

Ehrhardt, G. R. A., et al, "Th inhibitory potential of Fc receptor homolog 4 on memory B cells," *PNAS, USA*, 100(23):13489-13494 (Nov. 2003).

Ellison, J.W., et al., "The nucleotide sequence of a human immunoglobulin C$\gamma_1$ gene" *Nucleic Acids Research*, 10(13):4071-4079(1982).

Ernst, L. K., et al., "Molecular characterization of six variant Fcγ receptor class I (CD64) transcripts," *Molecular Immunology*, 35:943-954 (1998).

Facchetti, F., et al., "An unusual Fc receptor-related protein expressed in human centroblasts," *PNAS, USA*, 99(6):3776-3781 (Mar. 19, 2002).

Gaboriaud, C., et al., "The Crystal Structure of the Globular Head of Complement Protein C1q Provides a Basis for Its Versatile Recognition Properties," *J. Biol. Chem.*, 278(47):46974-46982 (2003).

Garman, S. C., et al., "Structure of the Fc fragment of human IgG bound to its high-affinity receptor FcεRIα," *Nature*, 406:259-266 (2000).

Getahun, A., et al., "IgG2a-Mediated Enhancement of Antibody and T Cell Responses and Its Relation to Inhibitory and Activating Fcγ Receptors," *J. of Immunology*, 172:5269-5276 (2004).

Ghazizadeh, S., et al., "Physical and Functional Association of Src-related Protein Tyrosine Kinases with FcRII in Monocytic THP-1 Cells," *J. Biol. Chem.*, 269(12):8878-8884 (Mar. 25, 1994).

Ghetie, V. et al., "FcRn: the MHC class I-related receptor that is more than an IgG transporter" *Immunology Today*, 18(12):592-598 (Dec. 1997).

Ghetie, V., et al., "Increasing the serum persistence of an IgG fragment random mutagenesis," *Nat. Biotechol.*, 15(7):637-640 (Jul. 1997).

Ghetie, V., et al., "Multiple Roles for the Major Histocompatibility Complex Class I-Related Receptor FcRn," *Annu. Rev. Immunol.* 18:739-766(2000).

Gonzales, N. R., et al., "SDR grafting of a murine antibody using multiple human germline templates to minimize its immunogenicity," *Molecular Immunology*, 41:863-872 (2004).

Greenwood, J. "Molecular Recognition in the Structure and Assembly of Filamentous Bacteriphages," Dissertation submitted to the University of Cambridge (Oct. 1989).

Greenwood, J., et al., "Structural motifs involved in human IgG antibody effector functions," *Eur. J. Immunol.*, 23(5):1098-1104 (May 1993).

Greenwood, J., et al., "Dual Importance of Positive Charge in the C-Terminal Region of Filamentous Bacteriophage Coat Protein for Membrane Insertion and DNA-Protein Interaction in Virus Assembly," *Virology*, 171:444-452 (1989).

Greenwood, J., et al., "Effector functions of matched sets of recombinant human IgG subclass antibodies," Dissertation submitted to Cambridge University, Cambridge, UK (Feb. 1993).

Greenwood, J., et al., "Engineering multiple-domain forms of the therapeutic antibody CAMPATH-1H: effects on complement lysis," *Ther Immunol.*, 1(5):247-255 (Oct. 1994).

Groh, V., et al., "Efficient cross-priming of tumor antigen specific T cells by dendritic cells sensitized with diverse anti-MICA opsonized tumor cells" *PNAS*, 102(18):6461-6466 (May 3, 2005).

Harrison, P. T., et al., "Domain swap chimeras to study the binding of IgG by Fc gamm RI, the high affinity receptor for IgG," *Biochem Soc Trans.*, 24(1):144S (Feb. 1996).

Hazenbos, W.L., et al., "Murine IgG1 complexes Trigger Immune Effector Functions Predominately via FcγRIII (CD16)," *J. of Immunology*, 161:3026-3032 (1998).

Henry, A. J., et al., "Participation of the N-Terminal of Cε3 in the Binding of Human IgE to Its High-Affinity Receptor FcεRI" *Biochemistry*, 36:15568-15578 (1997).

Hezareh, M., et al., "Effector Function Activities of a Panel of Mutants of a Broadly Neutralizing Antibody against Human Immunodeficiency Virus Type I," *Journal of Virology*, 75(24):12161-12168 (2001).

Hinton. P. R., et al., "Engineered human IgG Antibodies with Longer Serum Haff-Lives in Primates," *J. Biol Chem.*, 279(8):6213-6216 (Feb. 20, 2004).

Idusogie, E. E., et al., "Engineered Antibodies with Increased Activity to Recruit Complement," *J. of Immunology*, 166:2571-2575 (2001).

Idusogie, E.E., et al., "Mapping of the C1q Binding Site on Rituxan, a Chimeric Antibody with a Human IgG1 Fc," *J. of Immunology*, 164:4178-4184 (2000).

Isaacs, J. D., "Improving Serotherapy with Monoclonal Antibodies" dissertation submitted to the University of Cambridge (Mar. 1991).

Isaacs, J. D., et al., "From bench to bedside: discovering rules for antibody design, and improving serotherapy with monoclonal antibodies," *Rheumatology*, 40:724-738(2001).

Isaacs, J. D., et al., "Therapy with Monoclonal Antibodies, II. The contribution of Fcγ Receptor binding and the Influence of $C_H1$ and $C_3$ Domains on In Vivo Effector Function," *J. of Immunology*, 161:3862-3869 (1998).

Isaacs, J. D., et al., "Therapy with Monoclonal Antibodies: an in vivo model for the assessment of therapeutic potential," *J. Immunol.*, 148(10):3062-3071 (May 15, 1992).

Jefferis, R. et al., "Recognition sites on human IgG for Fc gamma receptors: the role of glycosylatin," *Immunol Letters*, 44(2-3):111-117 (Jan. 1995).

Jefferis, R., et al., "Interaction sites on human IgG-Fc for FcγR: current models," *Immunology Letts.*, 82:57-65 (2002).

Jefferis, R., et al., "Modulation of FcγR and human complement activation by IgG3-core oligosaccharide Interactions," *Immunology Letters,* 54:101-104 (1996) and errata at *Immunology Letters,* 58:67 (1997).

Jefferis, R., et al., "Molecular definition of interaction sites on human IgG for Fc receptors (huFc gamma R)," *Mol Immunol.,* 27(12):1237-1240 (Dec. 1990).

Jendeberg, L., et al., "Engineering of $Fc_1$ and $Fc_3$ from human immunoglobulin G to analyse subclass specificity for staphylococcal protein A," *Journal of Immunological Methods,* 201:25-34 (1997).

Junghans, R. P., et al., "The protection receptor for IgG catabolism is the $β_2$-microglobulin-containing neonatal intestinal transport receptor," *PNAS,* 93:5512-5516 (May 1996).

Kalergis, A.M., et al., "Inducing Tumor Immunity through the Selective Engagement of Activating Fcγ Receptors on Dendritic Cells" *J. Exp. Med.* 195(12):1653-1659 (Jun. 17, 2002).

Kan, K. S., et al., "Thioether-Bonded Constructs of Fabγ and Fcγ Modules Utilizing Differential Reduction of Interchain Disulfide Bonds," *Journal of Immunology,* 166:1320-1326 (2001).

Karassa, F. B., at al., "The role of FcγRIIA and IIIA polymorphisms in autoimmune diseases," *Biomedicine & Pharmacotherapy,* 58:286-291 (2004).

Kim, J. et al., "Mapping the site on human IgG for binding of the MHC class I-related receptor, FcRn" *Eur. J. Immunol.,* 29:2819-2825 (1999).

Kim, J. K., et al., "Localization of the site of the murine IgG1 molecule that is involved in binding to the murine intestinal Fc receptor," *Eur J Immunol.,* 24(10):2429-2439 (Oct. 1994).

Kim, J.K., et al., "Identifying amino acid residues that influence plasma clearance of murine IgG1 fragments by site-directed mutagenesis," *Eur J. Immunol.,* 24(3):542-548 (Mar. 1994).

Kim, T. D., et al., "Analysis of FcγRIII and IgG Fc Polymorphism Reveals Functional and Evolutionary Implications of Protein-Protein Interaction," *J. Mol. Evol.,* 53:1-9(2001).

Kurucz, I., et al., "Bacterially expressed human FcγRIIb is soluble and functionally active after in vitro refolding" *Immunology Letts.,* 75:33-40 (2000).

Lund, J., et al., "A protein structural change in aglycosylated IgG3 correlates with loss of huFc gamma R1 and huFc gamma R111 binding and/or activation," *Mol. Immunol.,* 27(11):1145-1153 (Nov. 1990).

Lund, J., et al., "Control of IgG/Fc glycosylation: a comparision of oligosaccharides from chimeric human/mouse and mouse subclass immunoglobulin Gs," *Mol Immunol.,* 30(8):741-748 (Jun. 1993).

Maenaka, K., et al., "The Human Low Affinity Fcγ Receptors IIa, IIb and III Bind IgG with Fast Kinetics and Distinct Thermodynamic Properties" *J. Biol. Chem.* 276(48):44898-44904 (2001).

Martin, W. L., et al., "Characterization of the 2:1 Complex between the Class I MHC-Related Fc Receptor and Its Fc Ligand in Solution," *Biochemistry,* 38:12639-12647 (1999).

Martin, W. L., et al., "Crystal Structure at 2.8 A of an FcRn/Heterodimeric Fc Complex: Mechanism of pH-Dependent Binding" *Molecular Cell,* 7:867-877 (Apr. 2000).

Masztalerz, A., et al., "Mechanisms of macrophage cytotoxicity in IL-2 and IL-12 mediated tumor regression," *Cancer Immunol Immunother,* 52:235-242 (2003).

Maxwell, K.F., et al., "Crystal structure of the human leukocyte Fc receptor, FcRIIa." *Nature Structural Biology,* 6(5):437-442 (May 1999).

Mayfield, S. P., et al., "Expression and assembly of a fully active antibody algae," *PNAS,* 100(2):438-442 (Jan. 21, 2003).

Mechetina, L.V., et al., "Identification of CD16-2, a novel mouse receptor homologous to CD16/FcγRIII," *Immunogenetics,* 4:463-468 (2002).

Merchant, A. M. et al., "An efficient route to human bispecific IgG," *Nat Biotechnol.,* 16(7):677-681 (1998).

Metes. D., et al., "Expression of Functional CD32 Molecules on Human NK Cells Is Determined by and Allelic Polymorphism of the Fcγ RIIC Gene," *Blood,* 91(7):2369-2380 (Apr. 1, 1998).

Michaelson, T. E., et al., "Antibody Dependent Cell-Mediated Cytotoxicity Induced by Chimeric Mouse-Human IgG Subclass and IgG3 Antibodies with Altered Hinge Region," *Molecular Immunology,* 29(3):319-326 (1992).

Michaelson, T. E., et al., "One disulfide bond in front of the second heavy chain constant region is necessary and sufficient for effector functions of human IgG3 without a genetic hinge," *PNAS,* 91:9243-9247 (Sep. 1994).

Michaelson, T. E., et al., "Primary Structure of the 'Hinge' Region of Human IgG3," *J Biol Chem.,* 252(3):883-889 (Feb. 1977).

Miller, I., et al., "ITRAs: a new family of immunoglobulinike receptors differentially expressed in B cells," *Blood,* 99(8):2662-2669 (Apr. 15, 2002).

Mimura, Y., et al., "Role of Oligosaccharide Residues of IgG1-Fc in Fcγ RIIb Binding," *J. Biol. Chem.,* 276(49):45539-45547 (Dec. 7, 2001).

Morgan, A., et al., "The N-terminal end of the CH2 domain of chimeric human IgG1 anti-HLA-DR is necessary for C1q, Fc gamma R1 and Fc gamma RIII binding," *Immunology,* 86(2):319-324 (Oct. 1995).

Nakamura, K., et al., "Dissection and optimization of immune effector functions of humanized anti-ganglioside GM2 monoclonal antibody," *Molecular Immunology,* 37:1035-1046(2000).

Neidhardt-Berard, E., et al., "Dendritic cells loaded with killed breast cells induce differentiation of tumor-specific cytoxic T lymphocytes" *Breast Cancer Res.,* 6R322-R328 (Apr. 30, 2004).

Nimmerjahn, F. et al., "Divergent Immunoglobulin-G Subclass Activity Through Selective Fc Receptor Binding" *Science,* 310:1510(2005).

Nimmerjahn, F., et al., "Fcγ RIV: A Novel FcR with Distinct IgG Subclass Specificity," *Immunity,* 23:41-51 (Jul. 2005).

Nimmerjahn, F., et al., "Supporting Online Material for: Divergent Immunoglobulin G Subclass Activity Through Selective Fc Receptor Binding" *Science,* 310:1510 (2005).

Niwa, R., et al., "Defucosylated Chimeric Anti-CC Chemokine Receptor 4 IgG1 with Enhanced Antibody-Dependnent Cellular cytotoxicity Shows Potent Therapeutic Activity to T-Cell Leukemia and Lymphoma," *Cancer Research,* 64:2127-2133 (Mar. 15, 2004).

Norderhaug, L., et al., "Chimeric mouse human IgG3 antibodies with an IgG4-like hinge region induce complement-mediated lysis more efficiently than IgG3 with normal hinge," *Eur J immunol.,* 21(10):2379-2384 (Oct. 1991).

O'Connor, S. J., et al., "Humanization of an antibody against human protein C and calcium-dependence involving framework residues," *Protein Engineering,* 11(4):321-328 (1998).

Ober, R. J., et al., "Differences in promiscuity for antibody-FcRn interactions across species: implications for therapeutic antibodies," *International Immunology,* 13(12):1551-1559 (2001).

Ober, R. J., et al., "Exocytosis of IgG as mediated by the receptor, FcRn: An analysis at the single-molecule level" *PNAS,* 101(30):11076-11081 (Jul. 27, 2004).

Okazaki, A., et al., "Fucose Depletion from Human IgG1 Oligosaccharide Enhances Binding Enthalpy and Association Rate Between IgG1 and Fcγ RIIIa," *J. Mol. Biol.,* 336:1239-1249 (2004).

Parren, P. W., et al., "Characterization of IgG FcR-mediated proliferation of human T-cells induced by mouse and human anti-CD3 monoclonal antibodies. Identification of a functional polymorphism to human IgG2 anti-CD3," *J. Immunol.,* 148(3):695-701 (Feb. 1992).

Parren, P. W., et al., "On the interaction of IgG subclasses with the low affinity Fc gamma RIIa (CD32) on human monocytes, neutrophils, and platelets. Analysis of a functional polymorphism to human IgG2," *J Clin Invest.,* 90(4):1537-1546 (Oct. 1992).

Pearce, K. H., et al., "Mutational Analysis of Thrombopoietin for Identification of Receptor and Neutralizing Antibody Sites," *J. Biol. Chem.,* 272(33):20595-20602 (1997).

Preithner, S., et al., "High concentrations of therapeutic Igg1 antibodies are needed to compensate for inhibition of antibody-dependnent cellular cytotoxicity by excess endogenous immunoglobulin G," *Molecular Immunology,* (2005).

Presta, L.G., et al., "Engineering therapeutic antibodies for improved function," *Biochemical Society Transactions,* 30(part 4):487-490 (2002).

Radaev, S., et al., "Recognition of IgG by Fcγ Receptor," *J. Biol. Chem.,* 276(19):16478-16483 (May 11, 2001).

Radaev, S., et al., "Review: Recognition of immunoglobulins by Fcγ Receptor," *Molecular Immunology,* 38:1073-1083 (2001).

Radaev, S., et al., "The Structure of Human Type III Fcγ Receptor in Complex with Fc," *J. Biol.Chem.*, 276(19):16469-16477 (May 11, 2001).

Rafiq, K., et al., "Immune complex-mediated antigen presentation induces tumor immunity" *J. Clin. Invest.* 110:71-79(2002).

Raghavan, M., et al., "Fc Receptors and Their Interactions with Immunoglobulins" *Annu. Rev. Cell Div. Biol.*, 12:181-220 (1996).

Ravetch, J. V., et al., "IgG Fc Receptors" *Annu. Rev. Immunol.*, 19:275-290(2001).

Ravetch, J. V., et al., "Immune Inhibitory Receptors," *Science*, 290:84-89 (Oct. 6, 2000).

Ravetch, J.V., et al., "Fc Receptors," *Annu. Rev. Immunol.*, 9:457-492 (1991).

Reddy, P. R., et al., "Elimination of Fc Receptor-Dependent Effector Functions of a Modified IgG4 Monoclonal Antibody to Human CD4" *J. Immunol.*, 164:1925-1933(2000).

Redpath, S., et al., "The Influence of the Hinge Region Length in Binding of Human IgG to Human Fcγ Receptors," *Human Immunology*, 59:720-727 (1998).

Rozsnyay, Z., et al., "Distinctive role of IgG1 and IgG3 isotypes in FcR-mediated functions," *Immunology*, 66(4):491-498 (Apr. 1989).

Sandlie, A.A., "The extended hinge region of IgG3 is not required for high phogocytic capacity mediated by Fc gamma receptors, but the heavy chains must be disulfide bonded," *Eur J. Immunol.* 23(7):1546-1551 (Jul. 1993).

Sarmay, G., et al., "Mapping and Comparison of the Interaction Sites on The Fc Region of IgG Responsible for Triggering Antibody Dependent Cellular Cytotoxicity (ADCC) Through Different Types of Human FCγ Receptor," *Molecular Immunology*, 29(5):633-639 (1992).

Sautes-Fridman, C., et al., "Fc Gamma Receptors: A Magic Link with the Outside World," *ASHI Quarterly*, 148-151, (Fourth Quarter 2003).

Sensel, M. G., et al., "Amino Acid Differences in the N-Teminus of $C_H2$ Influence The Relative abilities of IgG2 and IgG3 to Activate Complement" *Mol. Immunol.*, 34(14):1019-1029 (1997).

Shields, R. L., et al., "High Resolution Mapping of the Binding Site on Human IgG1 for Fcγ RI, Fcγ RII, Fcγ RIII, and FcRn and Design of IgG1 Varients with Improved Binding to the Fcγ R" *J. Biol. Chem.*, 276(9):6591-6604 (2001).

Shields, R. L., et al., "Lack of Fucose on human IgG1 N-Linked Oligodaccharide Improves Binding to Human Fcγ RIII and Antibody-dependent Cellular Toxicity" *J. Biol. Chem.*, 277(30)26733-26740 (2002).

Shinkawa, T., et al., "The Absence of Fucose but Not the Presence of Galactose or Bisecting N-Acetylglucosamine of Human IgG1 complex-type Oligosaccharides Shows the Critical Role of Enhancing Antibody-dependent Cellular Cytotoxicity" *J. Biol. Chem.*, 278(5):3466-3473 (2003).

Shopes, B., "A genetically engineered human IgG mutant with enhanced cytolytic activity," *J Immunol.*, 148(9):2918-2922 (May 1992).

Shopes, B., et al., "Recombinant human IgG1-murine IgE chimeric Ig. Construction, expression, and binding to human Fc gamma receptors," *J. Immunol.*, 145(11):3842-3848 (Dec. 1, 1990).

Simmons, L. C., et al., "Expression of full-length immunoglobulins in *Esherichia coli*; rapid and efficient production of a glycosylated antibodies" *J. Immunol. Methods*, 263:133-147(2002).

Smith, I. F. R., et al., "Addition of a μ-Tailpiece to IgG Results in Polymeric Antibodies with Enhanced Effector Functions Including Complement-Mediated Cytolysis by IgG4," *J. Immunology*, pp. 2226-2236(1995).

Smith, K.G., et al., "T cell activation by anti-T3 antibodies: comparison of IgG1 and IgG2b switch variants and direct evidence for accessory function of macrophage Fc receptors," *Eur J Immunol.*, 16(5):478-486 (May 1986).

Sonderman, P. et al., "Crystal structure of the soluble form of the human FCγ -receptor IIb: a new member of the immunoglobulin superfamily at 1.7A resolution" *EMBO Journal*, 18(5):1095-1103 (1999).

Sonderman, P., et al., "Human Fcγ Receptor IIb Expressed in *Escherichia coil* Reveals IgG Binding Capability" *Biol. Chem.* 380:717-721 (Jun. 1999).

Sonderman, P., et al., "Molecular Basis for Immune Complex Recognition: A comparison of Fc-Receptor Structures" *J. Mol. Biol.*, 309:737-749 (2001).

Sonderman, P., et al., "The 3.2 -A crystal structure of the human IgG1 Fc fragment -FcγRIII complex" *Nature*, 406:287-273 (Jul. 20, 2000).

Sorenson, V., et al., "Effect of the IgM and IgA secretory tailpieces on polymerization and secretion of IgM and IgG," *J Immunol.*, 156(8):2858-2865 (Apr. 1996).

Steplewski, Z., et al., "Biological activity of human-mouse IgG1, IgG2, IgG3, and IgG4 chimeric monoclonal antibodies with antitumor specificity," *PNAS USA*, 85:4852-4856 (Jul. 1988).

Stevenson, G. T., et al., "Preparation of Fcγ for addition to sulfhydryl-expressing ligands with minimal disturbance of the hinge," *J. of Immunological Methods*, 231:169-175(1999).

Tao, M., et al., "Structural Features of Human immunoglobulin G that Determine Isotype-specific Differences in Complement Activation," *J. Exp. Med.* 178:661-667 (Aug. 1993).

Tao, M., et al., "The Differential Ability of Human IgG1 and IgG4 to Activate Complement Is Determined by the COOH-terminal Sequence of the $C_22$ domain" *J. Exp. Med*, 173:1025-1028 (Apr. 1991).

Thommesen, J. E., et al., "Lysine 322 in the human IgG3 $C_H2$ domain is crucial for antibody dependent complement activation" *Molecular Immunology*, 37:995-1014(2000).

Tuijnman W. B., et al., "A flow cytometric rosetting assay for the analysis of IgG-Fc receptor interactions," *J Immunol Methods*, 127(2):207-214 (Mar. 1990).

Uchide, J. et al., "The Innate Mononuclear Phagocyte Network Depletes B Lymphocytes through Fc Receptor-dependent mechanisms during Anti-CD20 Antibody Immunotherapy" *J. Exp. Med.* 199(12):1659-1669 (Jun. 21, 2004).

Umana, P., et al., "Engineered glycoforms of an antineuroblastoma IgG1 with optimized antibody-dependent cellular cytotoxic activity," *Nature Biotechnology*, 17:176-180(1999).

Van Royen-Kerkhof, A, et al., "Flow cytometric determination of Fcγ RIIa (CD32) polymorphism," *J. Immunol. Methods*, 294:135-144 (2004).

Van Schie, R.C.A.A., et al., "Evaluation of Human Fcγ RIIA (CD32) and Fcγ RIIIB (CD16) Polymorphisms in Caucasians and African-Americans Using Salivary DNA," *Clinical and Diagnostic Laboratory Immunology*, 7(4):676-681 (Jul. 2000).

Van Sorge, N. M., et al., "Fcγ R polymorphisms: Implications for function, disease and susceptibility and immunotherapy" *Tissue Antigens*, 63:189-202(2003).

Vidarte, L., et al., "Serine 132 Is the C3 Covalent Attachment Point of the CH1 domain of Human IgG1" *J. Biol. Chem.*, 276(41):38217-38223 (2001).

Ward, E. S., et al., "Evidence to support the cellular mechanism involved in serum IgG homeostatis in humans" *International Immunology*, 15(2):187-195 (2003).

Warmerdam, P. A., et al., "Interaction of a human Fc gamma RIIb1 (CD32) isoform with murine and human IgG subclasses," *Int Immunol.*, 5(3):239-247 (Mar. 1993).

Wawrzynczak, E. J., et al., "Recombinant mouse monoclonal antibodies with single amino acid substitutions affecting C1q and high affinity Fc receptor binding have identical serum half-lives in the BALB/c mouse," *Mol. Immunol.*, 29(2):221-227 (Feb. 1992).

Weiner, L. M., et al., "Tunable antibodies," *Nature Biotechnology*, 23(5):556-557 (May 2005).

Weng, W., et al., "Clinical Outcome of Lymphoma Patients After Idiotype Vaccination Is Correlated With Humoral Immune Response and Immunoglobulin G Fc Receptor Genotype," *J. Clin Oncol.*, 22(23):1-8 (2004).

Weng, W., et al., "Two Immunoglobulin G Fragment C Receptor Polymorphisms Independently Predict Response to Rituximab in Patients With Follicular Lymphoma," *Journal of Clinical Oncology*, 21(21):3940-3947 (Nov. 1, 2003).

West, A. P., et al., "Crystal Structure and immunoglobulin G Binding Properties of the Human Major Histocompatibility Complex-Related Fc Receptor," *Biochemistry*, 39:9898-9708(2000).

Wing, M. G., et al., "Mechanism of First-Dose Cytokine-Release Syndrome of CAMPATH 1-H:Involvement of CD16 (FcγRIII) and CD11a/CD18 (LFA-1)on NK Cells," *J. Clin. Invest.*, 98(12):2819-2826 (Dec. 1996).

Wolff, E.A., et al., "Monoclonal antibody homodimers: enhanced antitumor activity in nude mice," *Cancer Res.*, 53(11):2560-2565 (Jun. 1, 1993).

Wright, A., et al., "Effect of C2-Associated carbohydrate Structure on Ig Effector Function: Studies with Chimeric Mouse-Human IgG1 Antibodies in Glycosylation Mutants of Chinese Hamster Ovary Cells" *J. of Immunology*, 160:3393-3402 (1998).

Wright, A., et al., "In vivo trafficking and catabolism of IgG1 antibodies with Fc associated carbohydrates of differing structure," *Glycobiology*, 10(12):1347-1355 (2000).

Xu, D., et al., "In Vitro Characterization of Five Humanized OKT3 Effector Function Varient Antibodies," *Cellular Immunology*, 200:16-26 (2000).

Xu, M., et al., "Molecular Cloning and Characterization of SPAP1, an Inhibitory Receptor," *Biochemical and Biophysical Research Communications*, 280:768-775 (2001).

Xu, Y., et al., "Residue at Position 331 in the IgG1 and IgG4 $C_H2$ Domains Contributes to Their Differential Ability to Bind and Activate Complement" *J. Biol. Chem.* 269(5):3469-3474 (1994).

Zelaschi, D., et al., "Human immunoglobulin allotypes: previously unrecognized determinants and alleles defined with monoclonal antibodies," *PNAS, USA*, 80:3762-3766 (Jun. 1983).

Zhou, H., et al., "DNA-based vaccines activate innate and adaptive antitumor immunity by engaging the NKG2D receptor" *PNAS*, 102(31):10846-10851 (Aug. 2, 2005).

Zhou, J., et al., "Generation of Mutated Variants of the Human Form of the MHC Class I-related Receptor, FcRn, with Increased Affinity for Mouse Immunoglobulin G," *J. Mol. Biol.*, 332(4):901-13 (Sep. 2003).

Zhu, D., et al., "A novel human immunoglobulin Fc gamma Fc epsilon bifunctional fusion protein inhibits Fc epsilon RI-mediated degranulation," *Nat Med.*, 8(5):518-521 (May 2002).

Andreakos, E., et al., "Monoclonal antibodies in Immune and inflammatory diseases," *Curr. Opin. Biotech.*, 13:615-620 (2002).

Carter, P., "Improving the Efficacy of Antibody-Based Cancer Therapies," *Nature Reviews*, 1:118-129(2001).

Chadd, H., et al., "Therapeutic antibody expression technology," *Curr. Opin. Biotech.*, 12:188-194 (2001).

Clark, M. "Antibody humanization: a case of the 'Emperor's new clothes?'" *Immunol. Today*, 21(8):397-402 (2000).

Cragg, M., et al., "Signaling antibodies in cancer therapy," *Curr. Opin. Immunol.*, 11:541-547(1999).

Dall'Acqua, W., et al., "Antibody Engineering," *Curr. Opin Structural Biol.*, 8:443-450 (1998).

Glennie, M., et al., "Clinical trials of antibody therapy," *Immun. Today*, 21(8):403-410 (2000).

Glennie, M., et al., "Renaissance of cancer therapeutic antibodies," *Drug Discovery Today*, 8(11):503-510 (2003).

Hayhurst, A., et al., "High-throughput antibody isolation," *Curr. Opin. Chem. Biol.*, 5:683-689(2001).

Hogarth, P., "Fc receptors are major mediators of antibody based inflammation in autoimmunity," *Curr. Opin. Immun.*, 14:798-802 (2002).

Holliger, P., et al., "Antibodies come back from the brink," *Nature Biotechnology*, 16:1015-1016 (1998).

Hudson, P., "Recombinant antibody constructs in cancer therapy," *Curr. Opin. Immunology*, 11:548-557 (1999).

Hudson, P., "Recombinant antibody fragments," *Curr. Opin in Biotechnology*, 9:395-402 (1998).

Johnson, G., et al., "Kabat Database and its applications: 30 years after the first variability plot," *Nucleic Acids Research*, 28(1):214-218 (2000).

Johnson, G., et al., "Kabat Database and its applications: future directions," *Nucleic Acids Research*, 29(1):205-206 (2001).

Maynard, J., et al., "Antibody Engineering," *Annu. Rev. Biomed. Eng.*, 2:339-376 (2000).

Morea, V., et al., "Antibody Modeling: Implications for Engineering and Design," *Methods*, 20:267-279(2000).

Penichet, M., et al., "Antibody-cytokine fusion proteins for the therapy of cancer," *Journal of Immunological Methods*, 248:91-1010 (2001).

Reichert, J., "Monoclonal antibodies in the clinic," *Nature Biotechnology*, 19:819-822 (2001).

Thrush, G., et al., "Immunotoxins: An Update," *Ann. Rev. Immunol.*, 14:49-71 (1996).

Torphy, T., et al., "Pharmaceutical biotechnology Monoclonal antibodies: boundless potential, daunting challenges—Editorial Overview," *Curr. Opin. Biotechnol.*, 13:589-591 (2002).

Trail, P., et al., "Monoclonal antibody drug conjugates in the treatment of cancer" *Curr. Opin. Immunol.*, 11:584-588 (1999).

Trikha, M., "Monoclonal antibodies as therapeutics in oncology," *Curr. Opin. Biotech.*, 13:609-614 (2002).

Van Dijk, M., et al., "Human antibodies as next generation therapeutics," *Curr. Opin. Chem. Biol.*, 5:368-374 (2001).

Van Sorge, N., et al., "Fcγ R polymorphisms: Implications for function, disease susceptibility and immunotherapy," *Tissue Antigens*, 61:189-202 (2003).

Vasserot, A., et al., "Optimization of protein therapeutics by directed evolution," *Drug Discovery Today*, 8(3):118-126 (2003).

Waldmann, T., et al., "Emerging Therapies: Spectrum of Application of Monoclonal Antibody Therapy," *Hemotology*, 394-408 (2000).

Yamane-Ohnuki N. et al., "Establishment of FUT8 knockout chinese hamster ovary cells: an ideal host cell line for producing completely defucosylated antibodies with enhanced antibody-dependent cellular cytoxicity", *Biotechnology and Bioengineering Interscience Publishers, London, GB*, vol. 87, No. 5, Sep. 5, 2004.

* cited by examiner

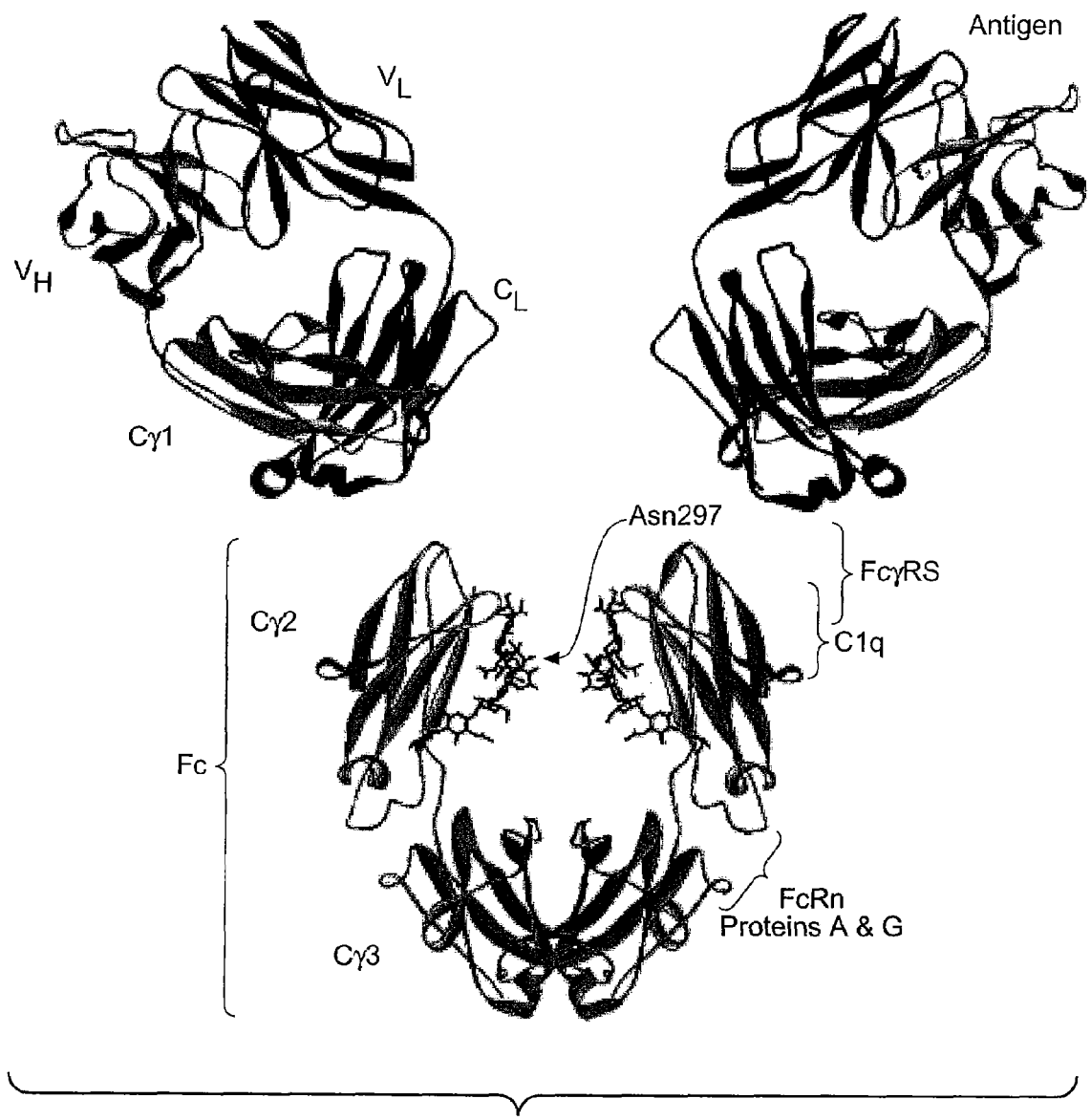
FIG._1

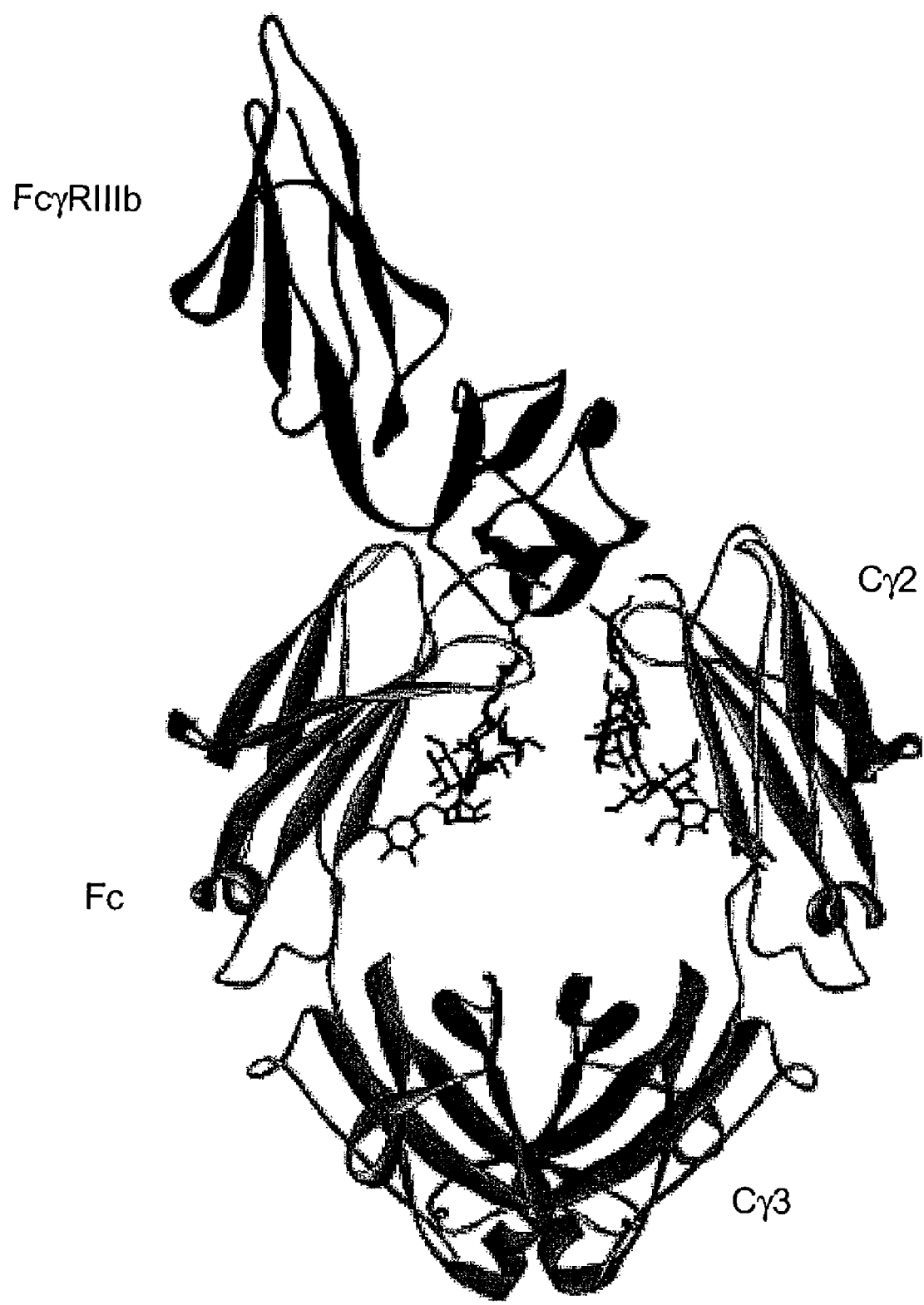
FIG._2

SEQ ID NO: 1

VH1->
```
1         10        20        30        40        50        60
123456789012345678901234567890123456789012345678901234567890
QVQLQESGPGLVRPSQTLSLTCTVSGFTFTDFYMNWVRQPPGRGLEWIGFIRDKAKGYTT 70        80        90       100       110       120
123456789012345678901234567890123456789012345678901234567890
EYNPSVKGRVTMLVDTSKNQFSLRLSSVTAADTAVYYCAREGHTAAPFDYWGQGSLVTVS
```

Cγ1->
```
         130       140       150       160       170       180
123456789012345678901234567890123456789012345678901234567890
SASTKGPSVFPLAPSSKSTSGGTAALGCLVKDYFPEPVTVSWNSGALTSGVHTFPAVLQS
```

HINGE->
```
         190       200       210       220       230       240
123456789012345678901234567890123456789012345678901234567890
SGLYSLSSVVTVPSSSLGTQTYICNVNHKPSNTKVDKKVEPKSCDKTHTCPPCPAPELLG
                                            1234567890123456
                                       KABAT  22        23
```

Cγ2->
```
         250       260       270       280       290       300
123456789012345678901234567890123456789012345678901234567890
GPSVFLFPPKPKDTLMISRTPEVTCVVVDVSHEDPEVKFNWYVDGVEVHNAKTKPREEQY
7890123456789012345678901234567890123456789012345678901234567
 240       250       260       270       280       290
```

?Cγ3?->
```
         310       320       330       340       350       360
123456789012345678901234567890123456789012345678901234567890
NSTYRVVSVLTVLHQDWLNGKEYKCKVSNKALPAPIEKTISKAKGQPREPQVYTLPPSRD
789012345678901234567890123456789012345678901234567890123456
 300       310       320       330       340       350

370       380       390       400       410       420
123456789012345678901234567890123456789012345678901234567890
ELTKNQVSLTCLVKGFYPSDIAVEWESNGQPENNYKTTPPVLDSDGSFFLYSKLTVDKSR
789012345678901234567890123456789012345678901234567890123456
 360       370       380       390       400       410

430       440       450
1234567890123456789012345678901
WQQGNVFSCSVMHEALHNHYTQKSLSLSPGK
7890123456789012345678901234567
 420       430       440
```

FIG._3

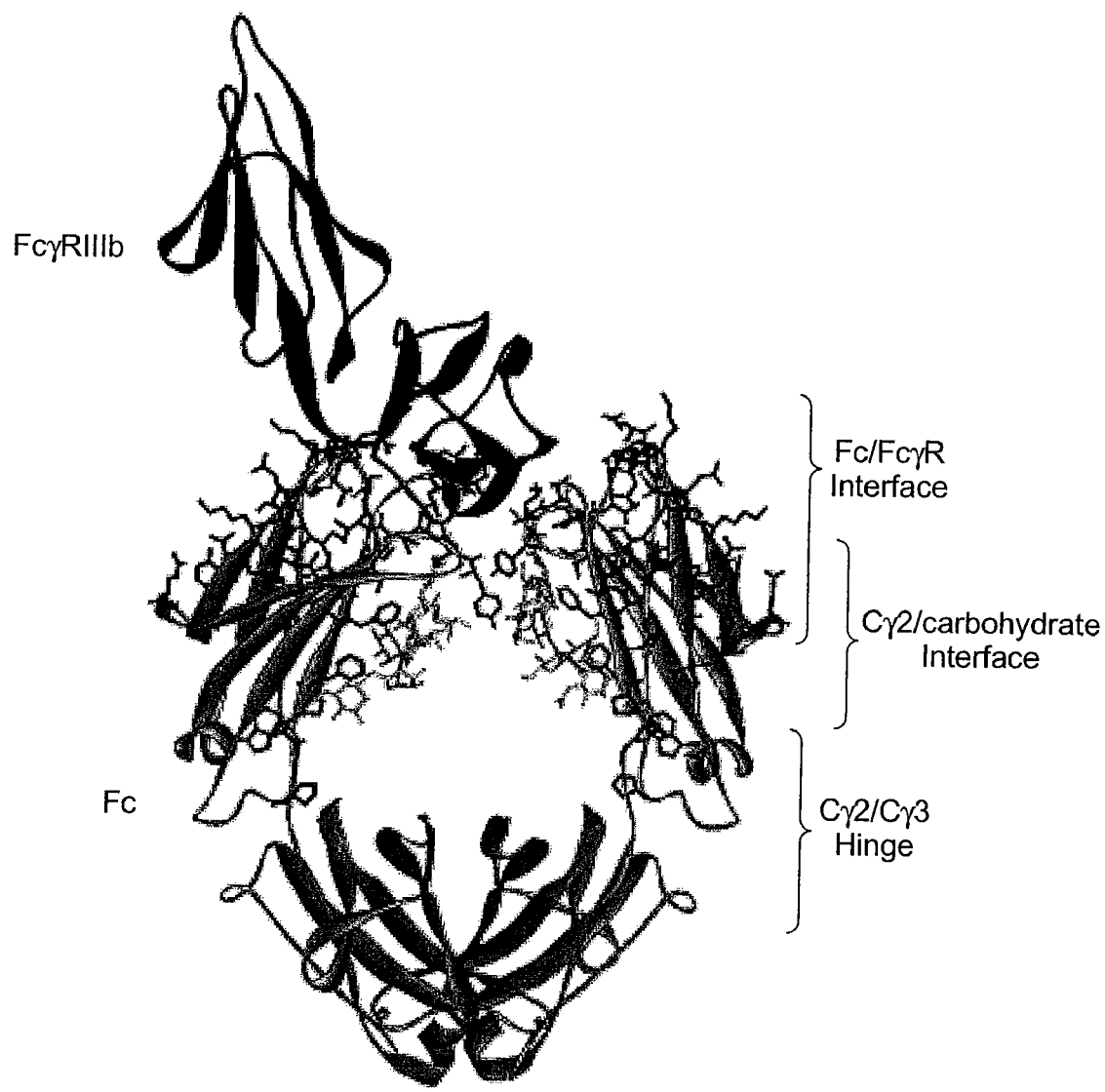
FIG._4

SEQ ID NO: 2

```
          22         23         24         25         26         27         28
 1234567890123456789012345678901234567890123456789012345678901234567890
 DKTHTCPPCPAPELLGGPSVFLFPPKPKDTLMISRTPEVTCVVVDVSHEDPEVKFNWYVD 29         30         31         32         33         34
 1234567890123456789012345678901234567890123456789012345678901234567890
 GVEVHNAKTKPREEQYNSTYRVVSVLTVLHQDWLNGKEYKCKVSNKALPAPIEKTISKAK 35         36         37         38         39         40
 1234567890123456789012345678901234567890123456789012345678901234567890
 GQPREPQVYTLPPSRDELTKNQVSLTCLVKGFYPSDIAVEWESNGQPENNYKTTPPVLDS 41         42         43         44
 1234567890123456789012345678901234567
 DGSFFLYSKLTVDKSRWQQGNVFSCSVMHEALHNHYTQKSLSLSPGK
```

FIG._5

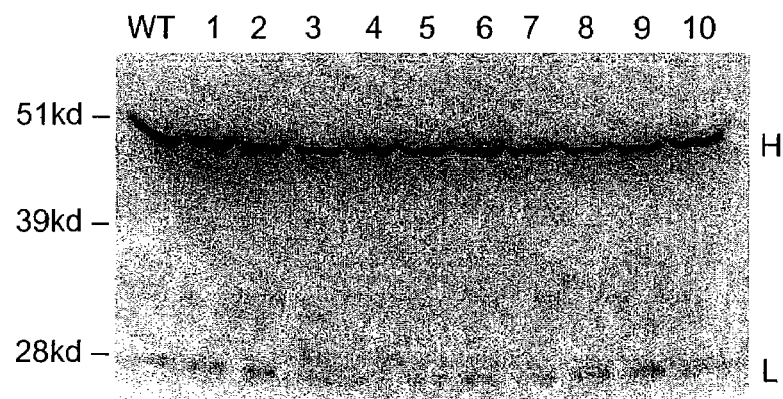
FIG._6
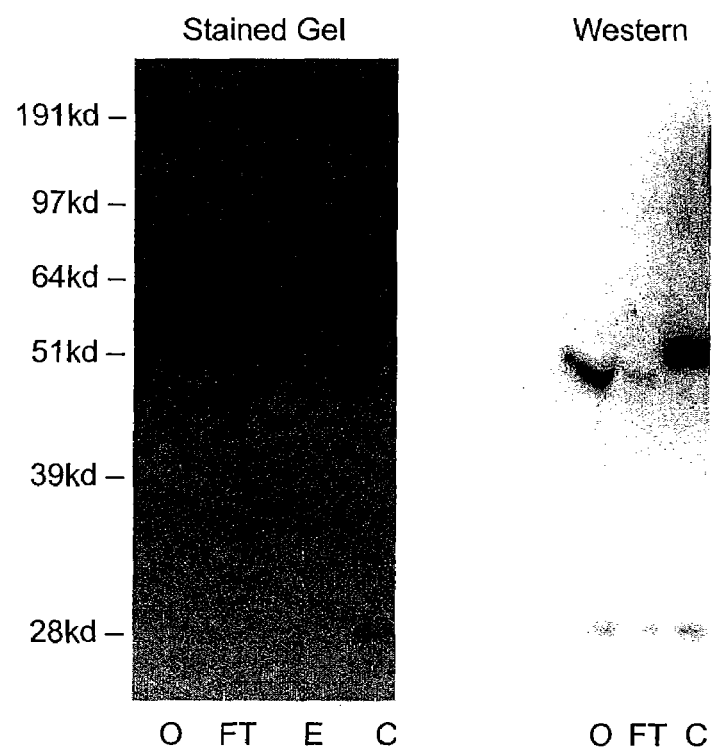
FIG._7

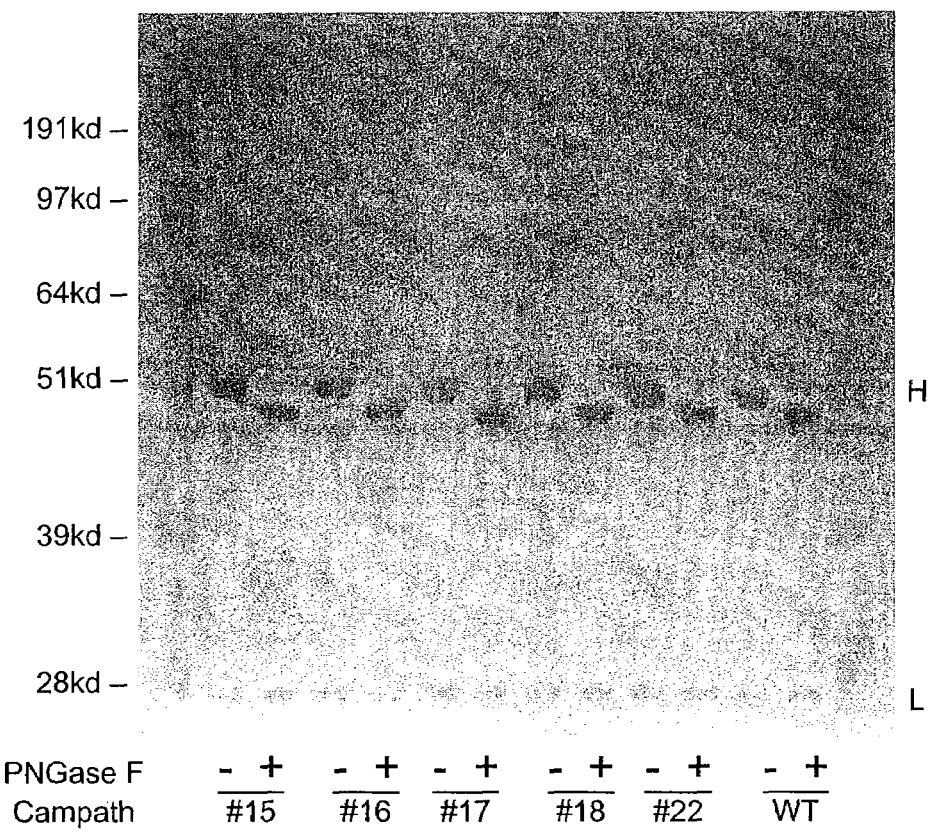
FIG._8
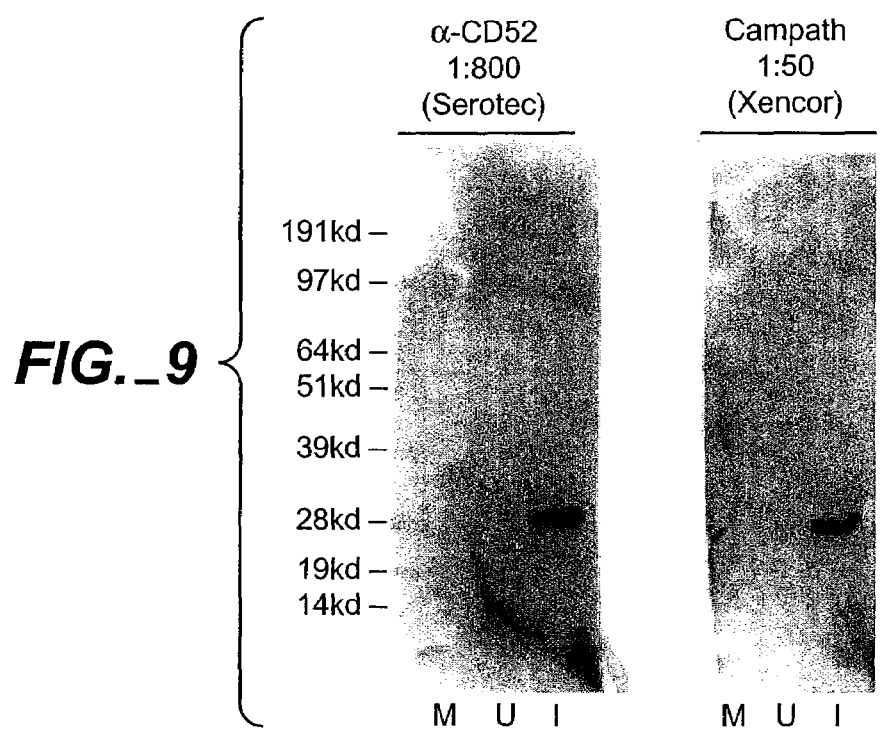
FIG._9

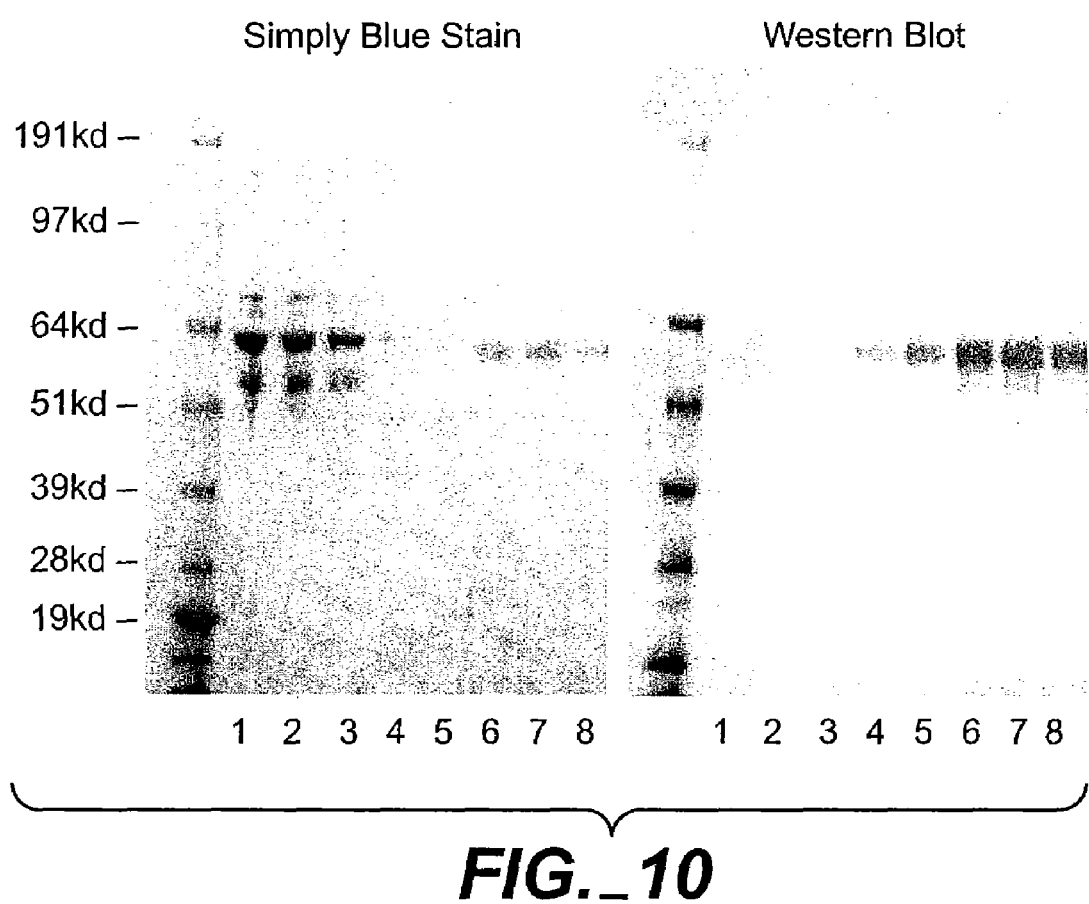
FIG._10

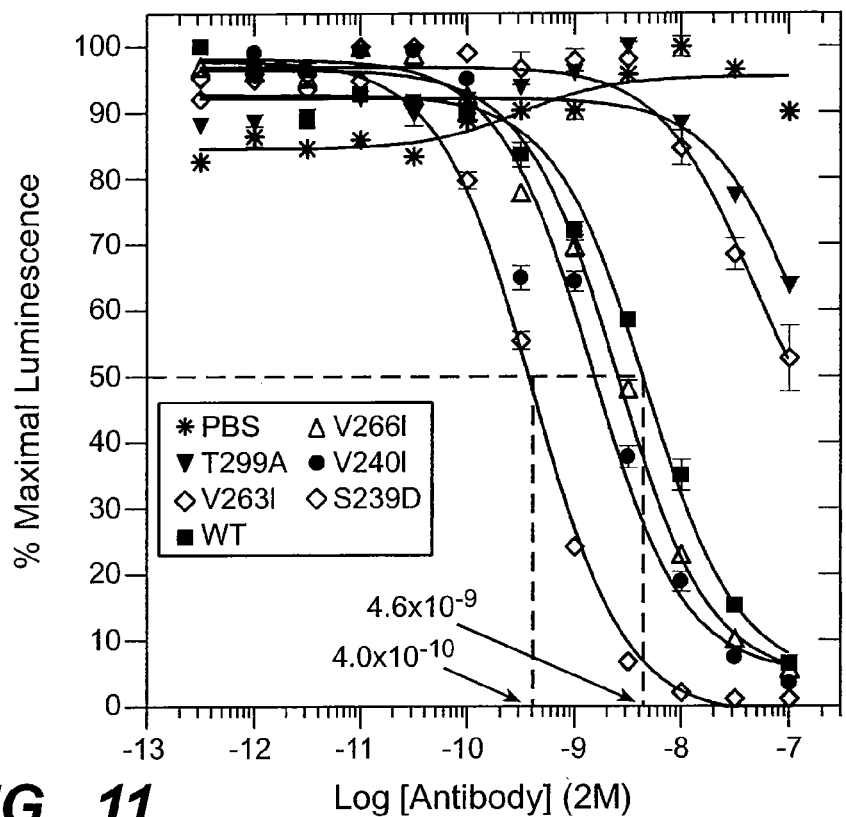
FIG._11
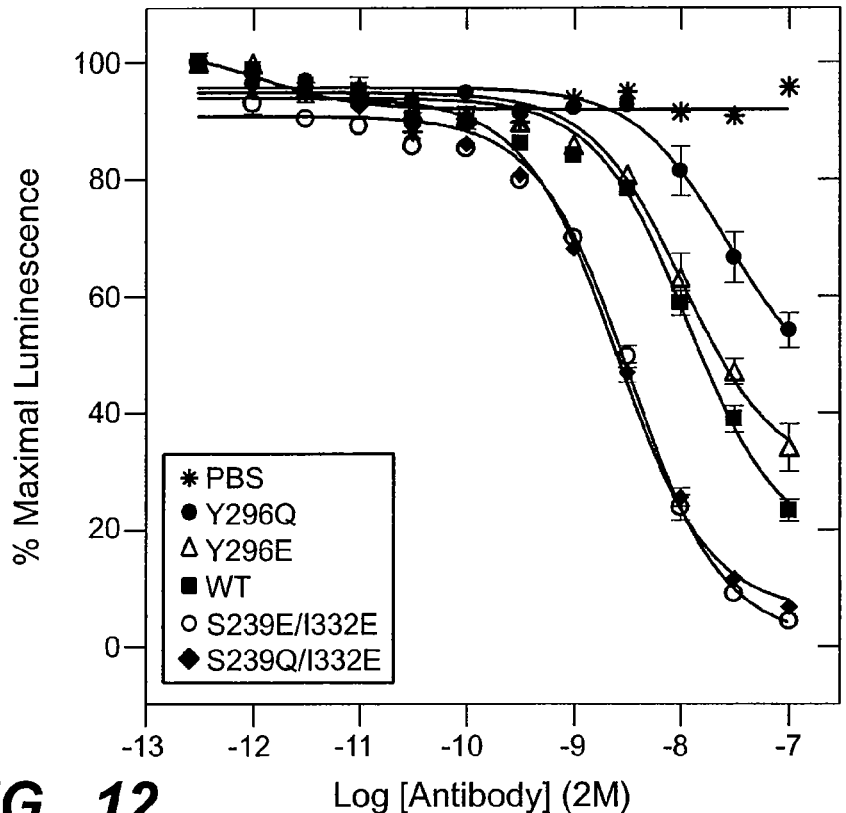
FIG._12

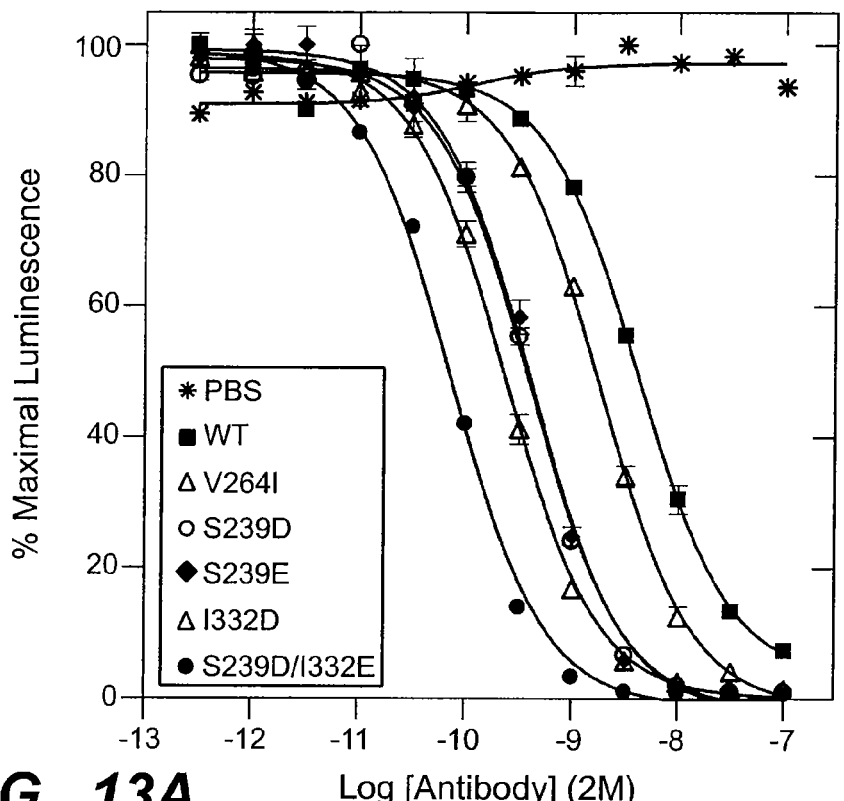
FIG._13A
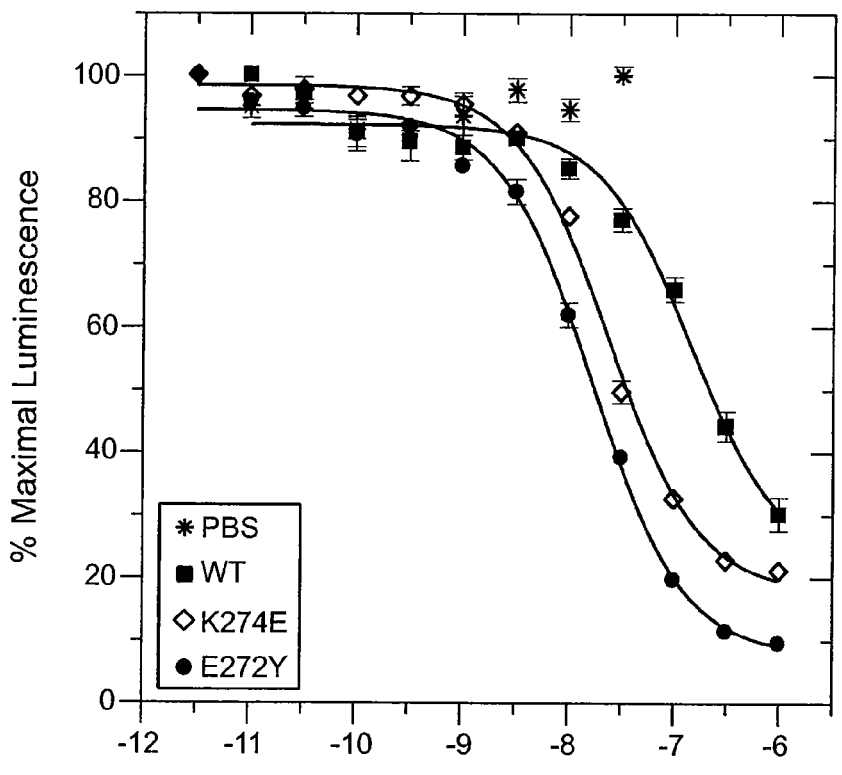
FIG._13B

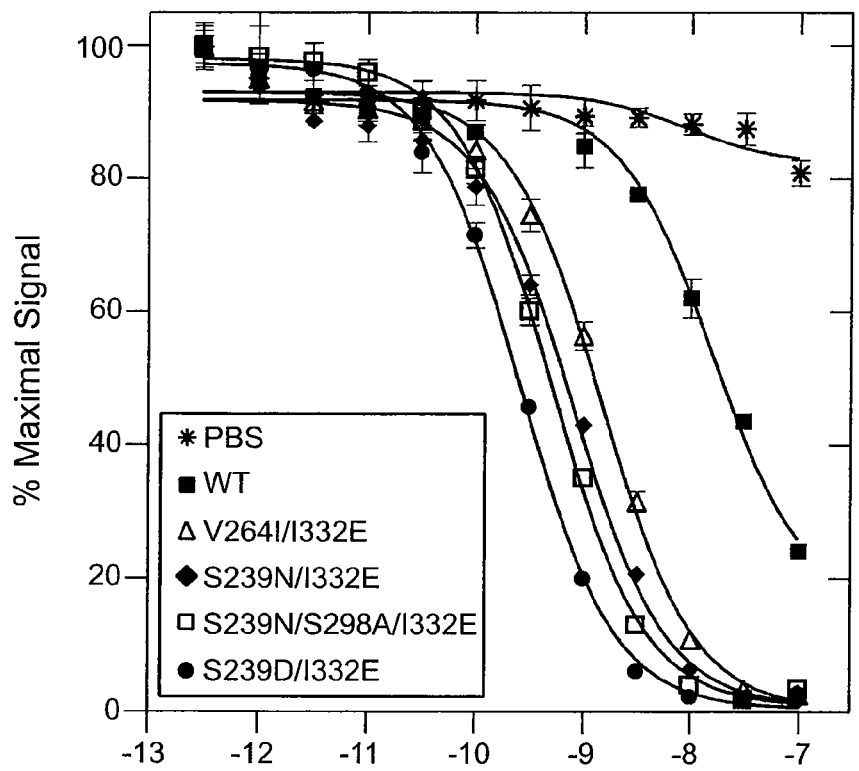
FIG._14A
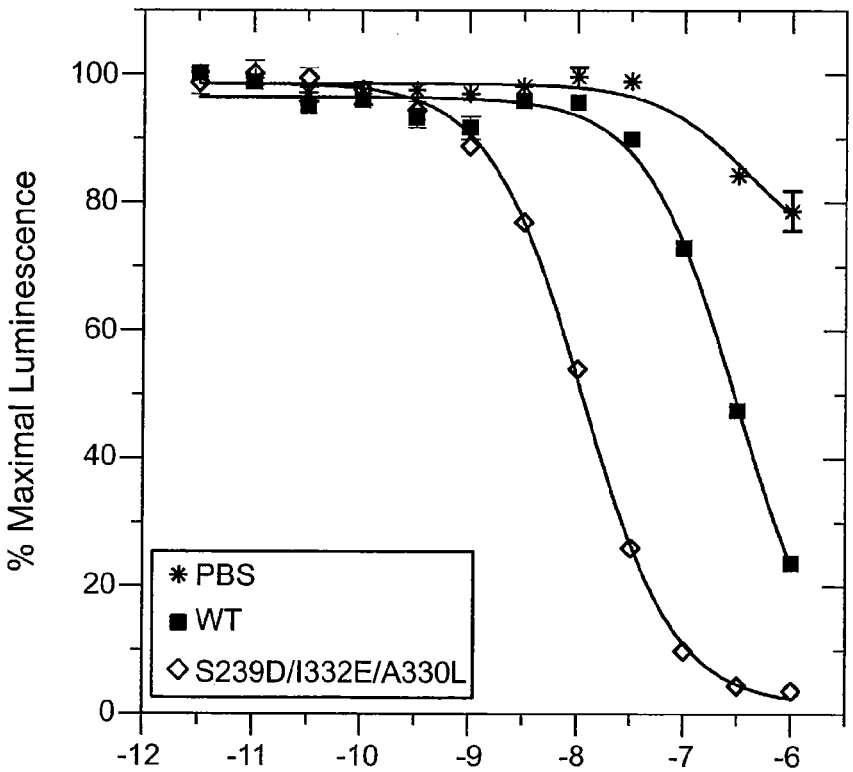
FIG._14B

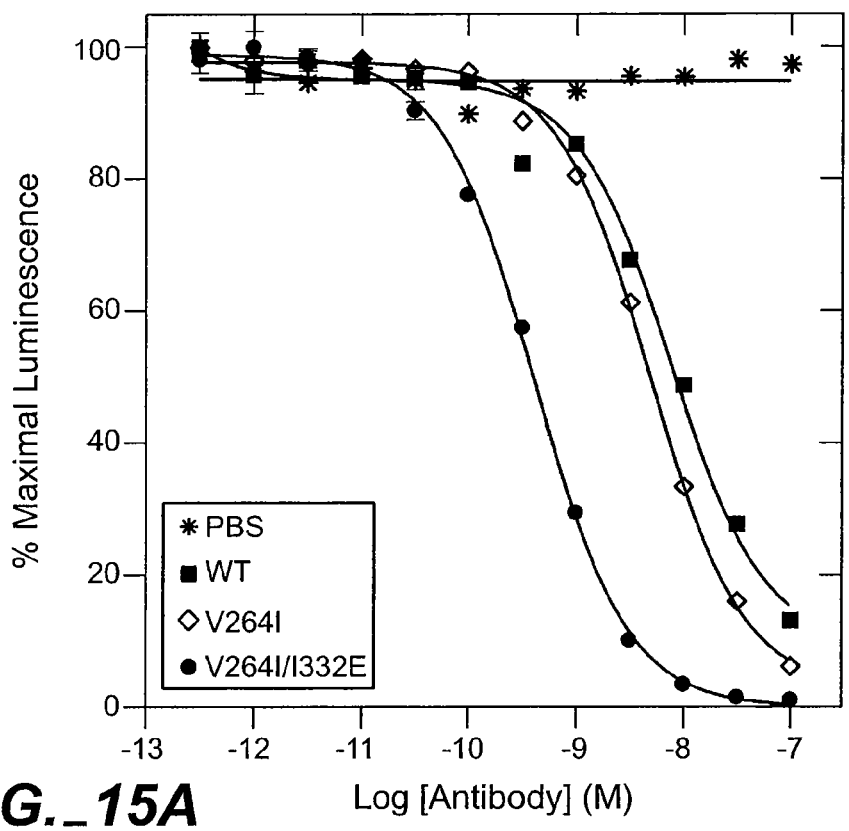
FIG._15A
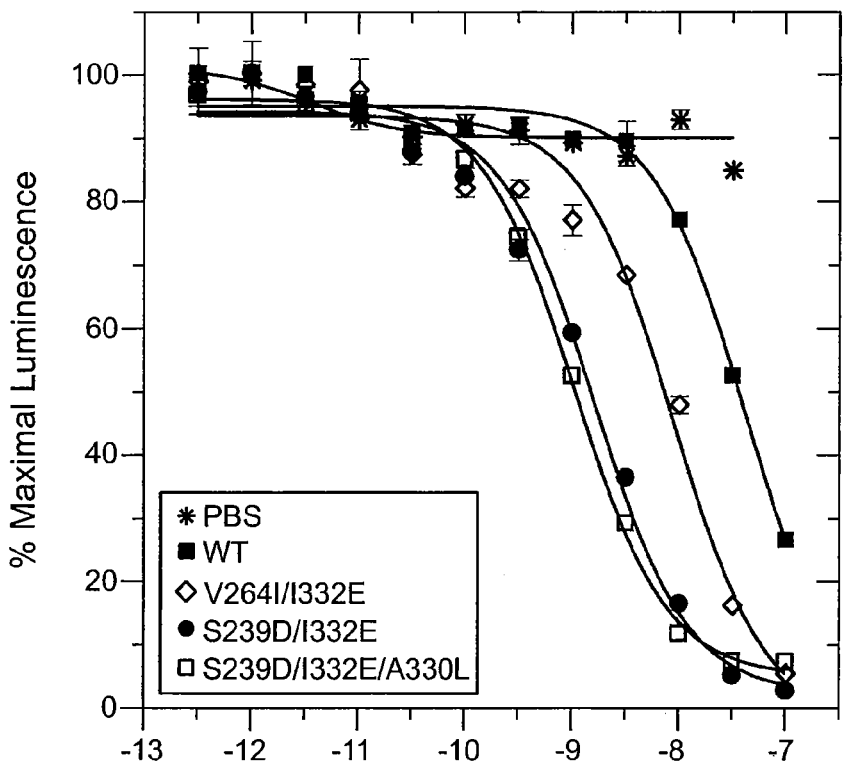
FIG._15B

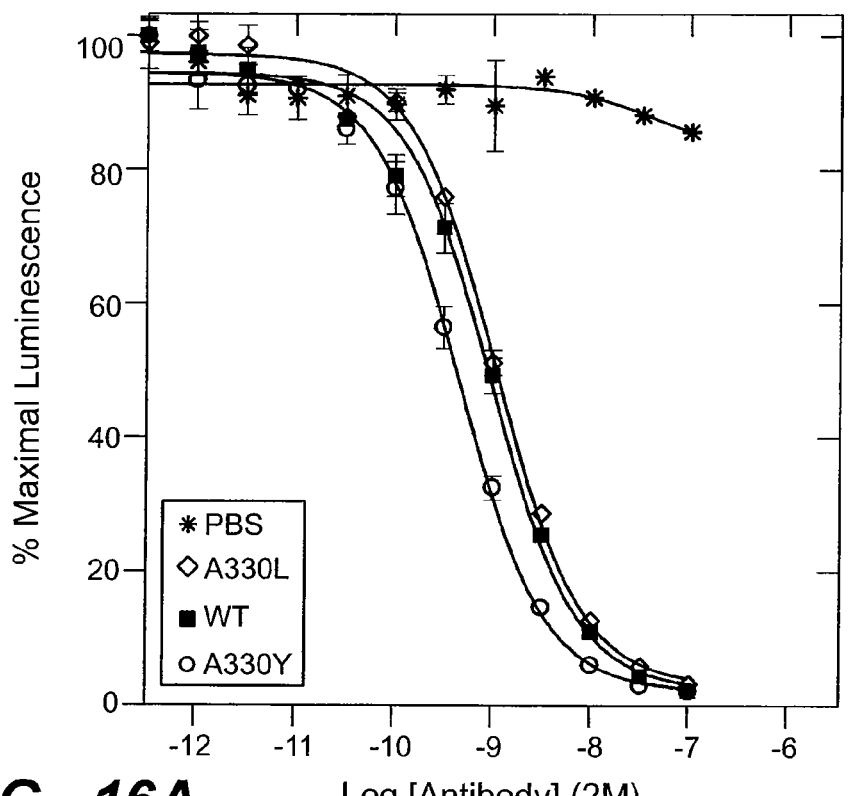
FIG._16A
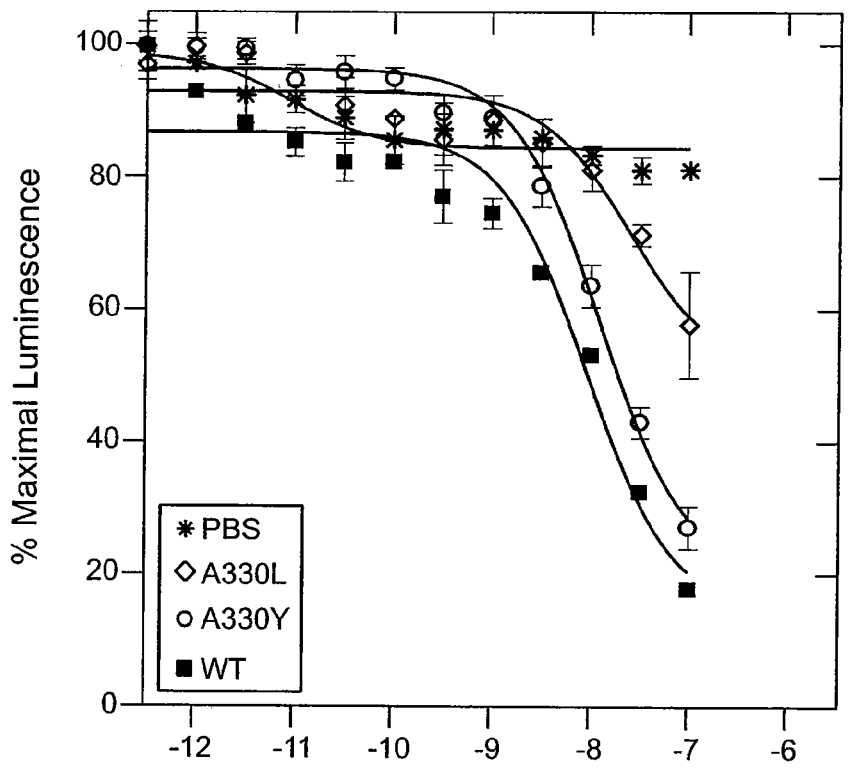
FIG._16B

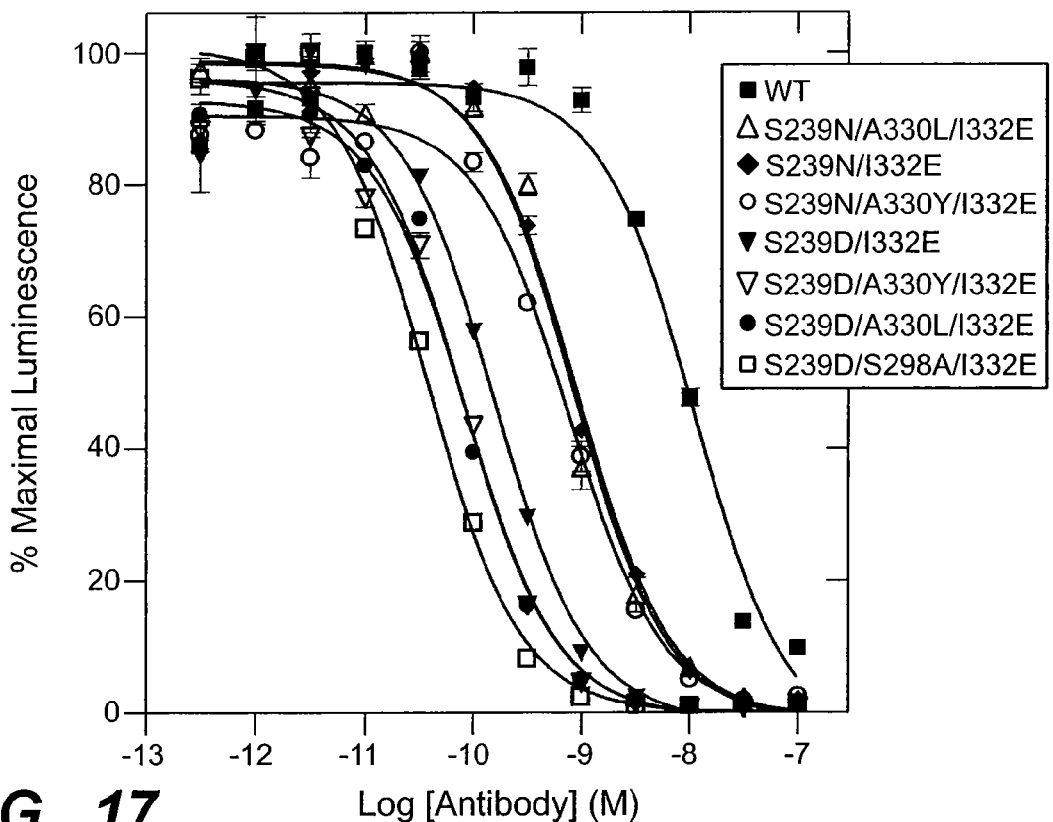
FIG._17
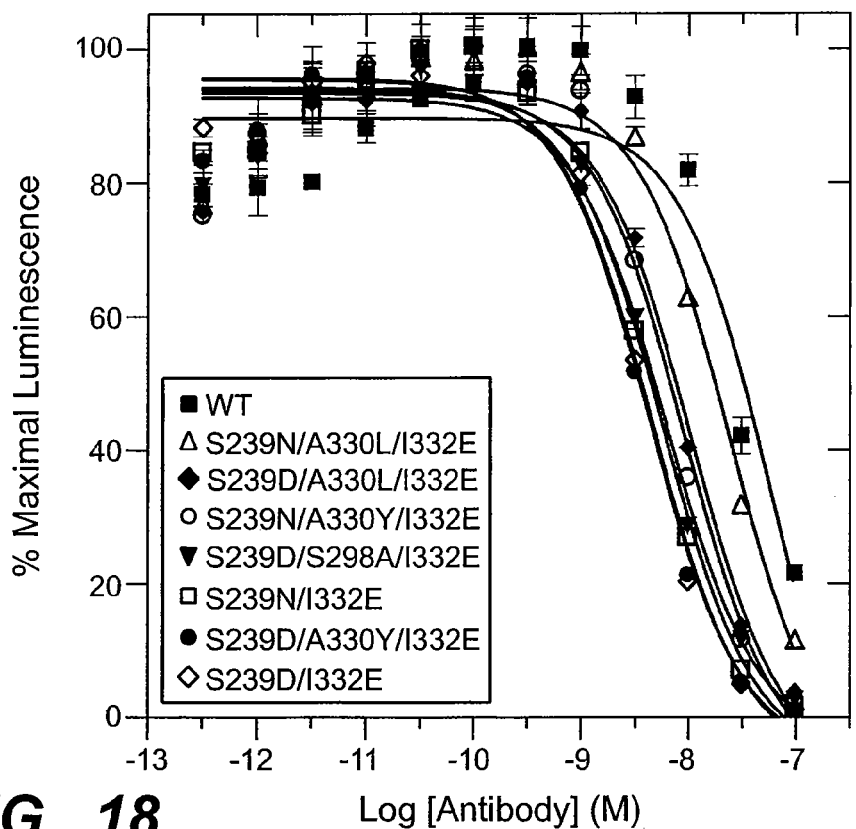
FIG._18

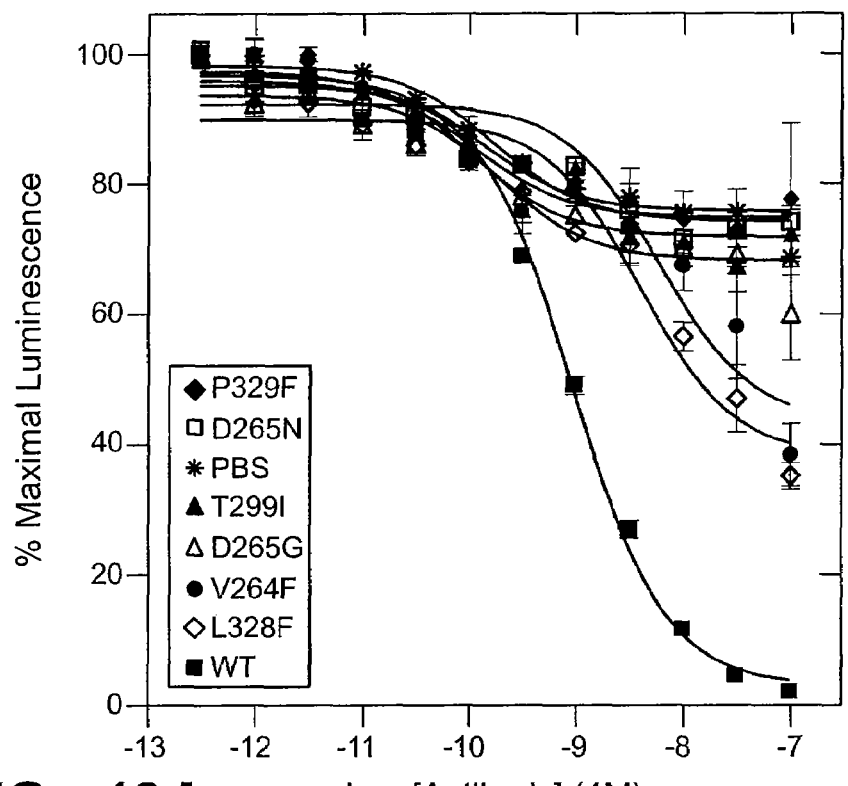
FIG._19A
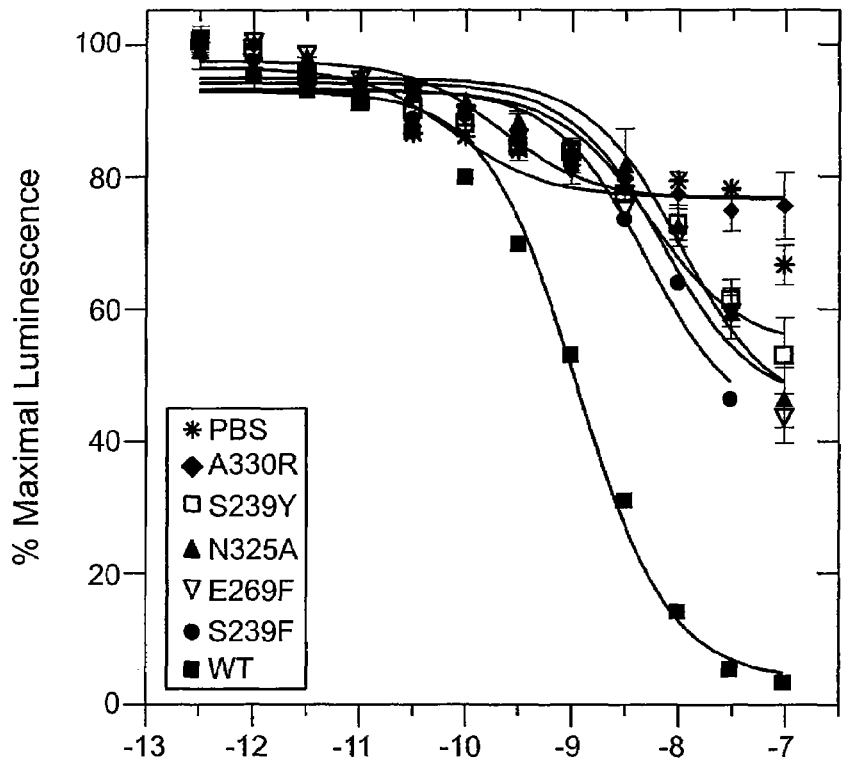
FIG._19B

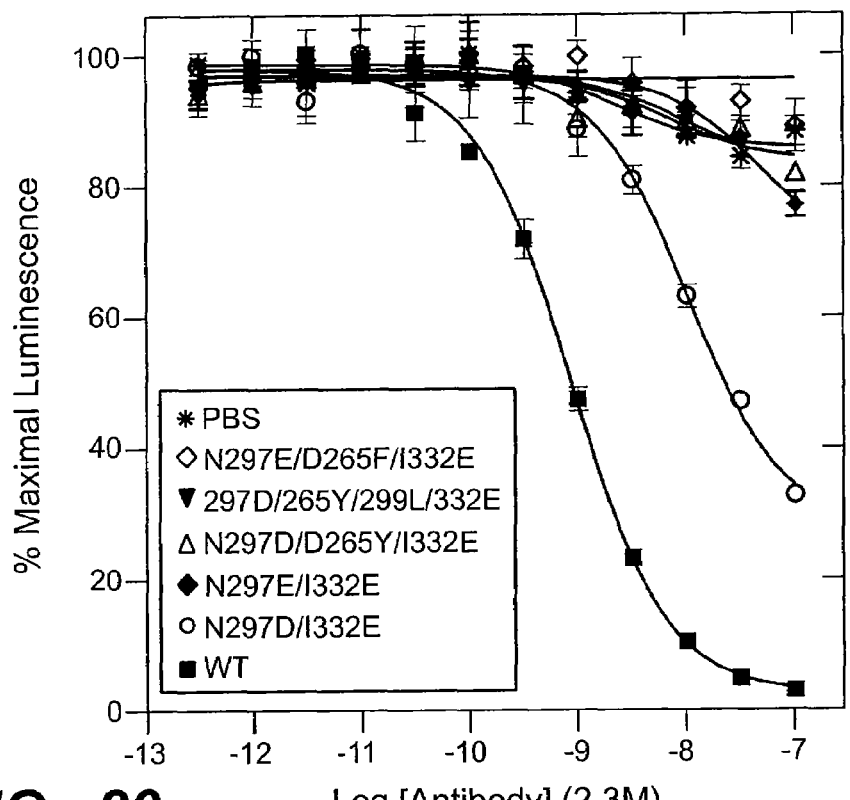
FIG._20
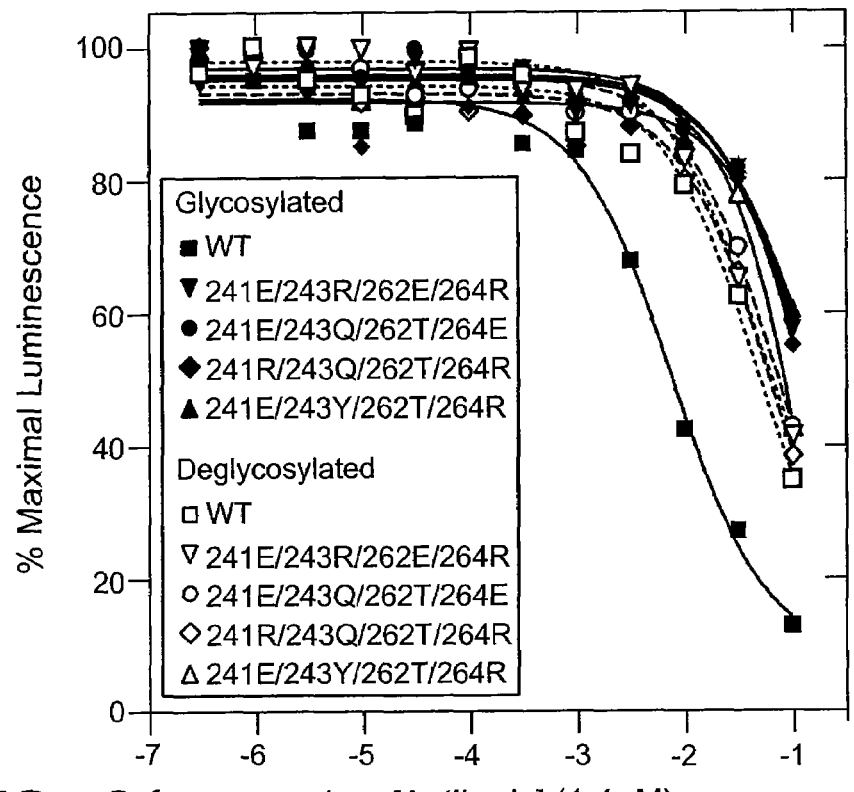
FIG._21

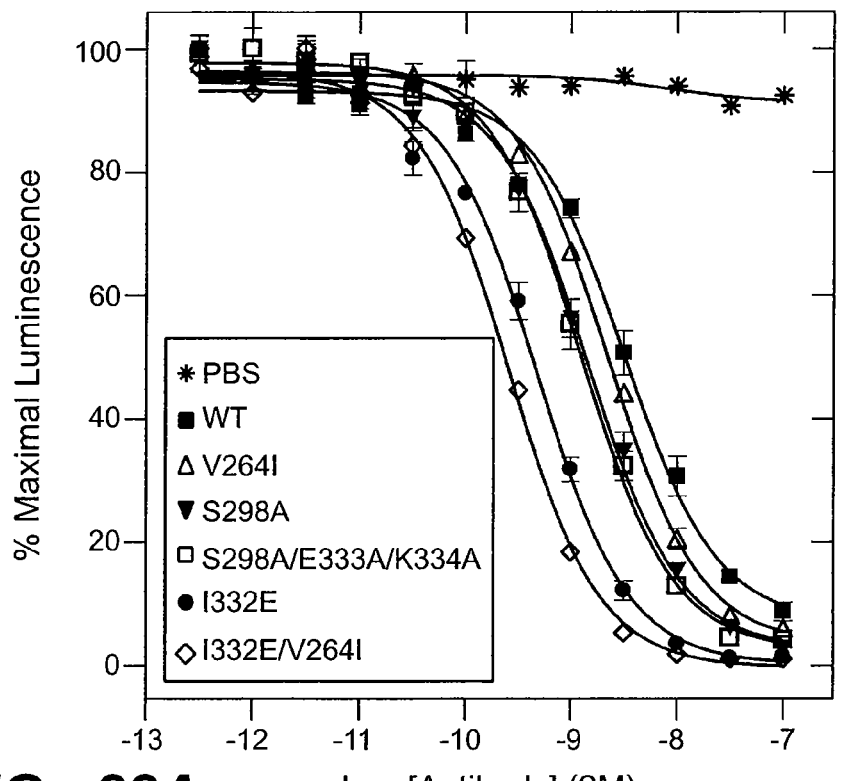
FIG._22A
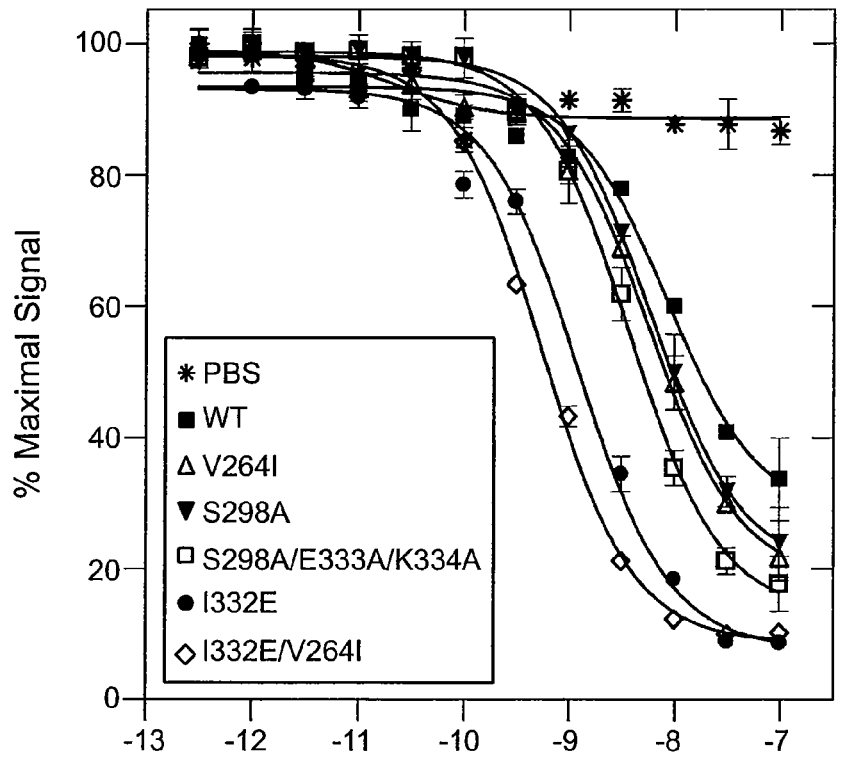
FIG._22B

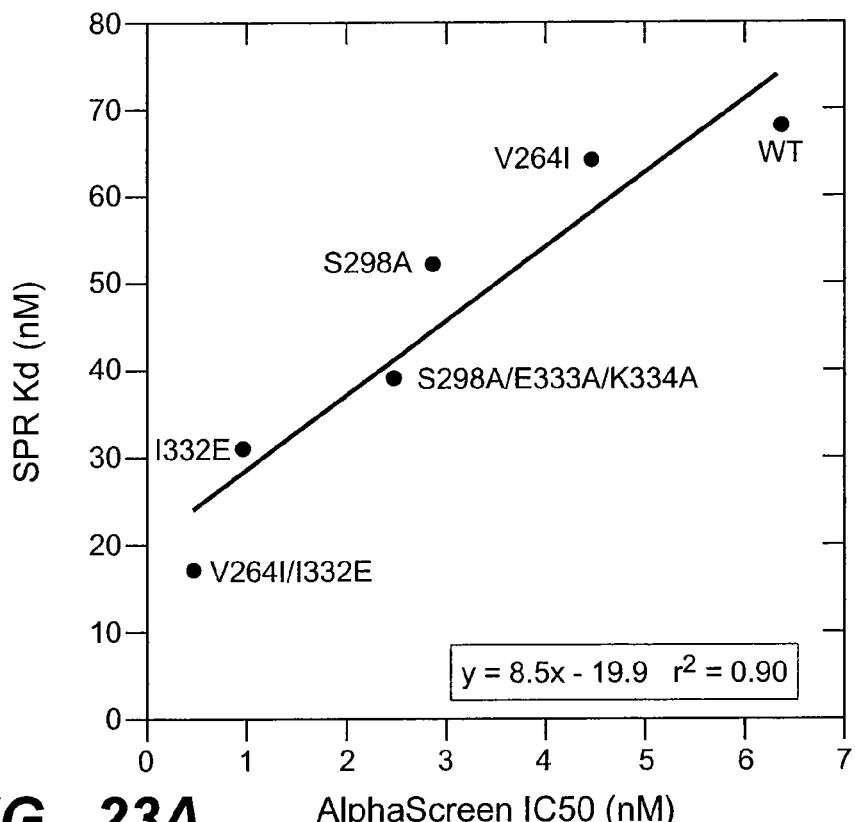
FIG._23A
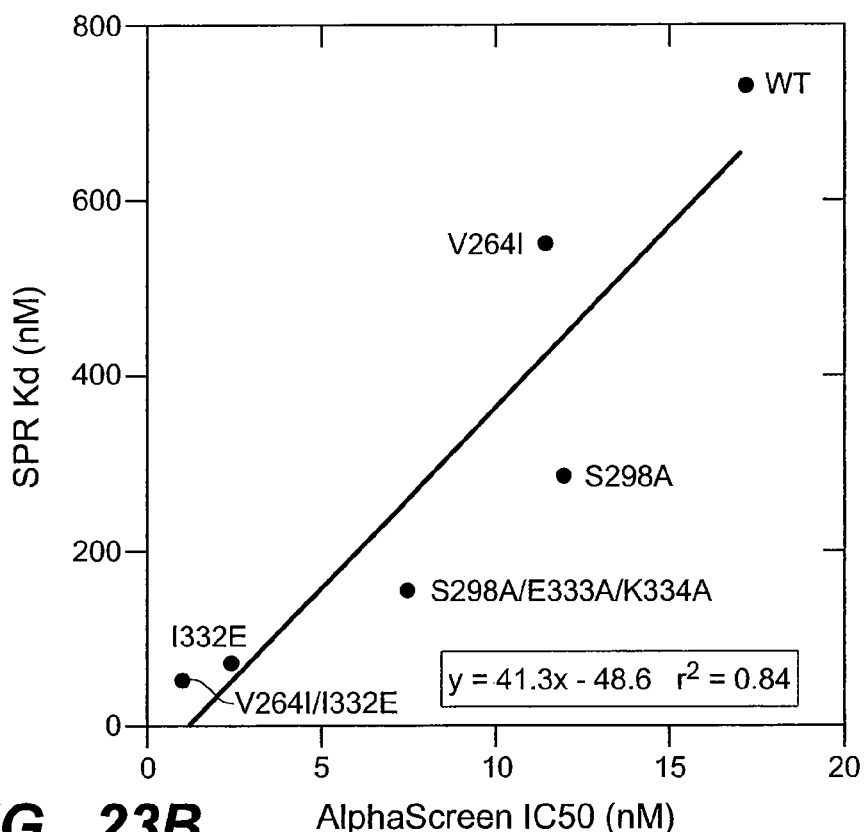
FIG._23B

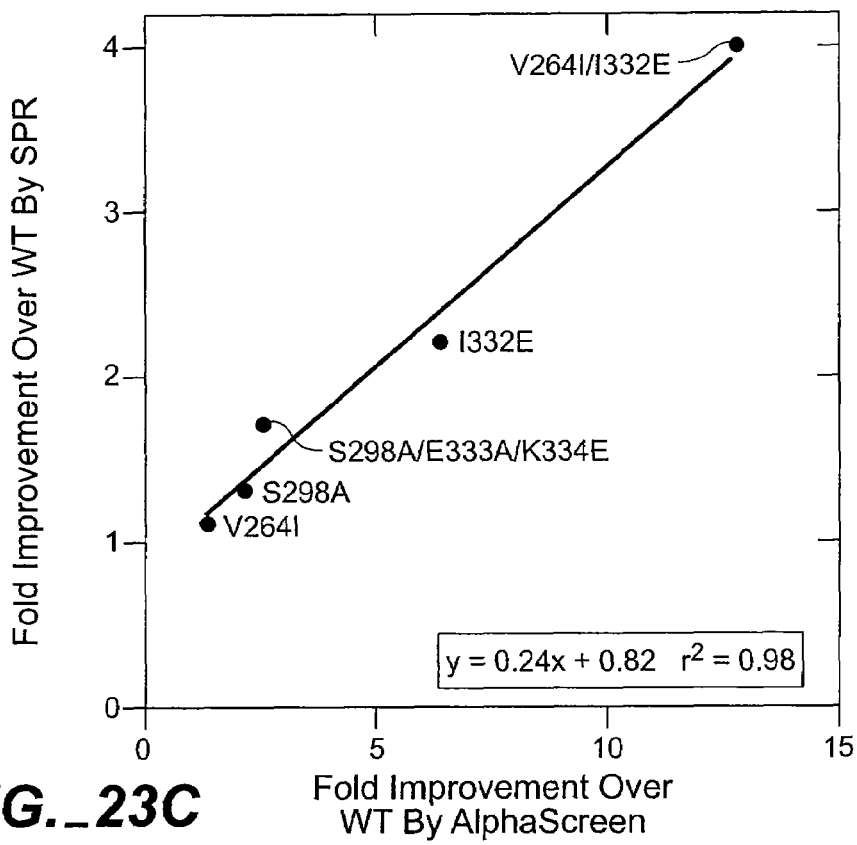
FIG._23C
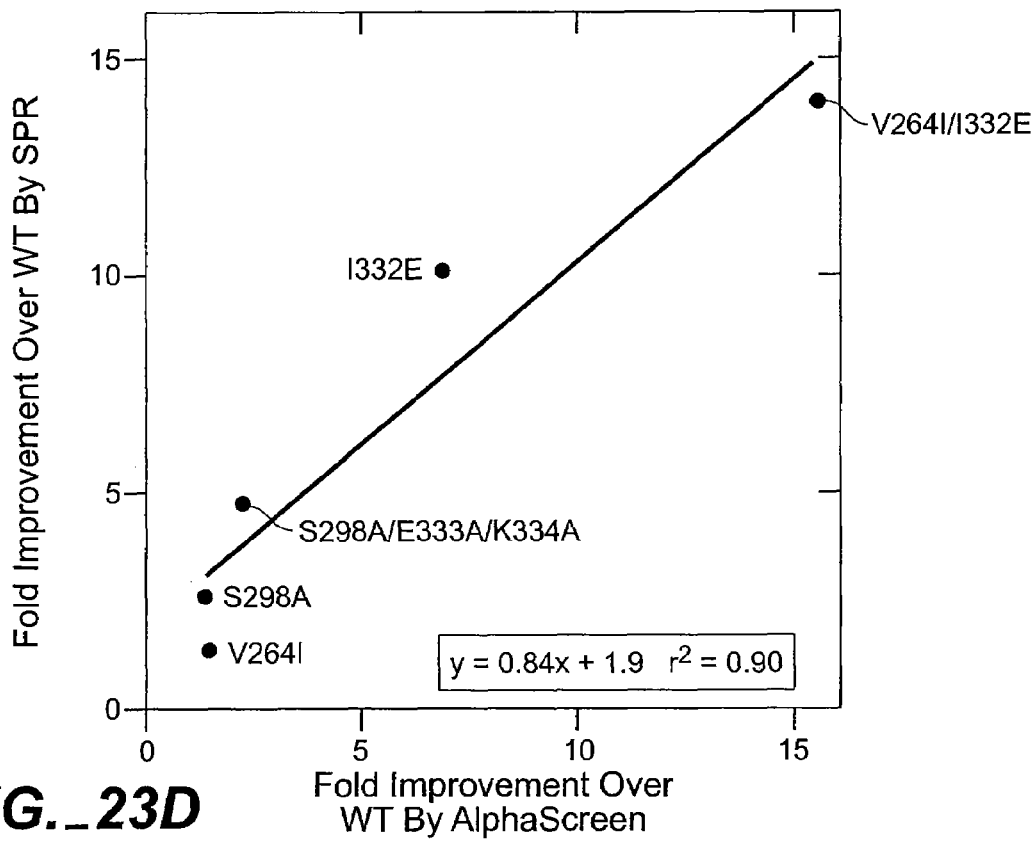
FIG._23D

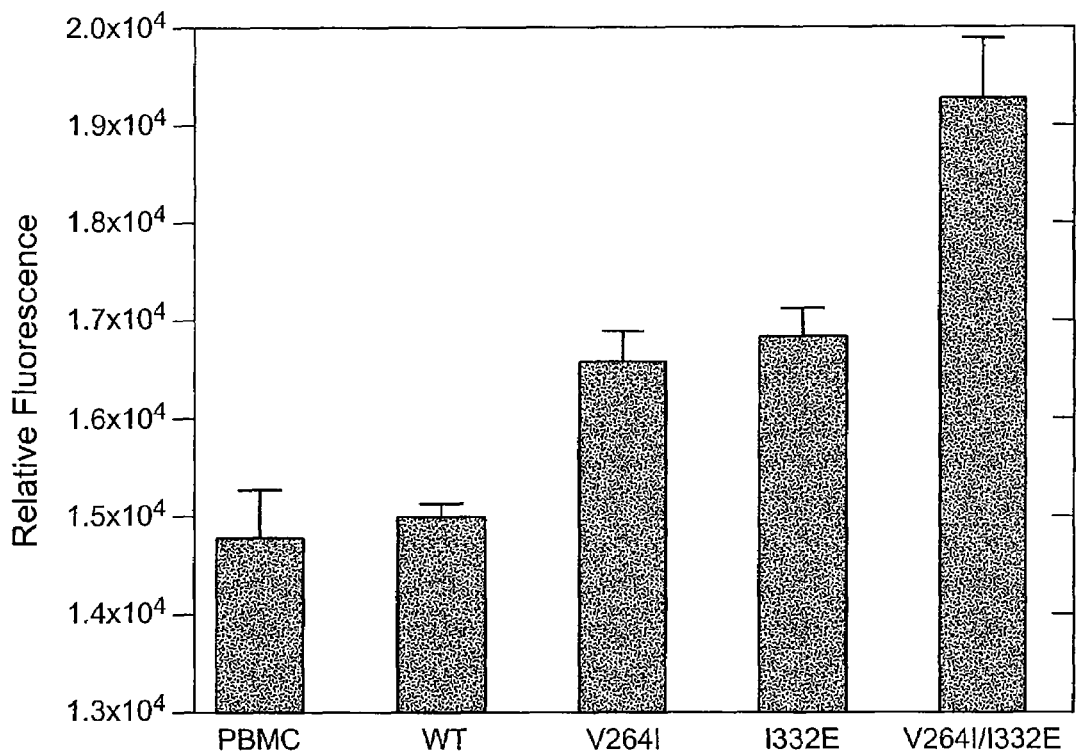
FIG._24A
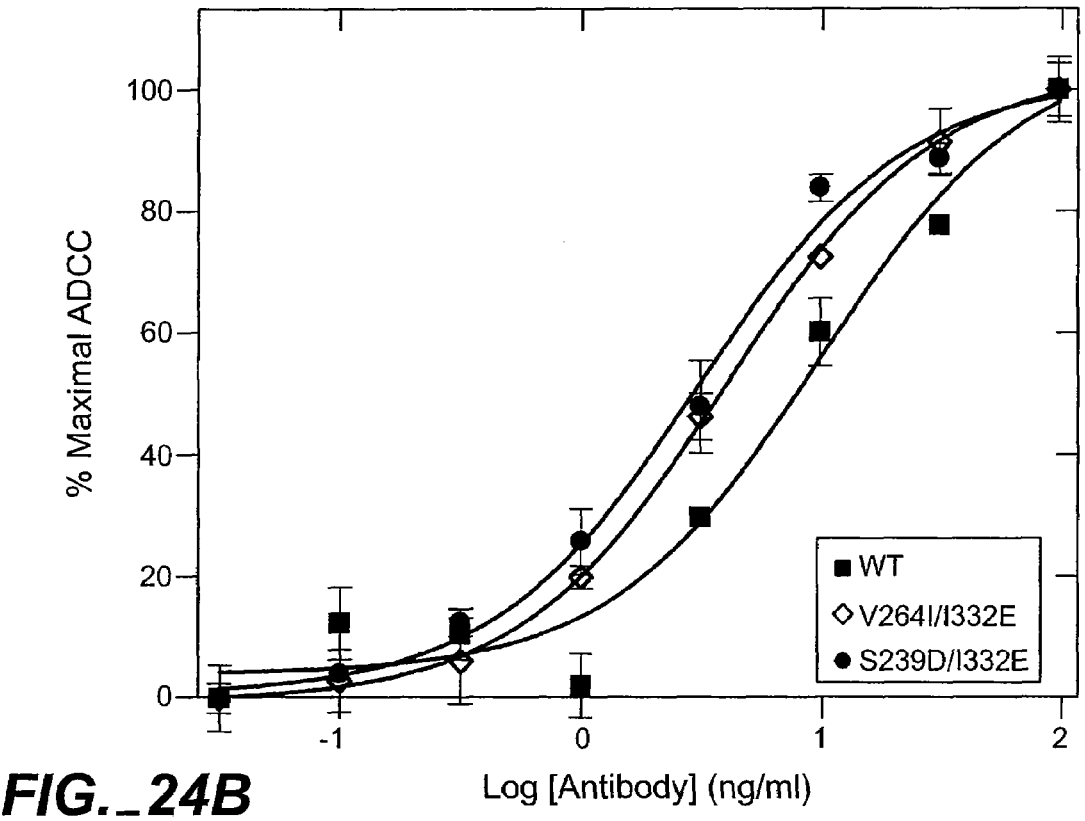
FIG._24B

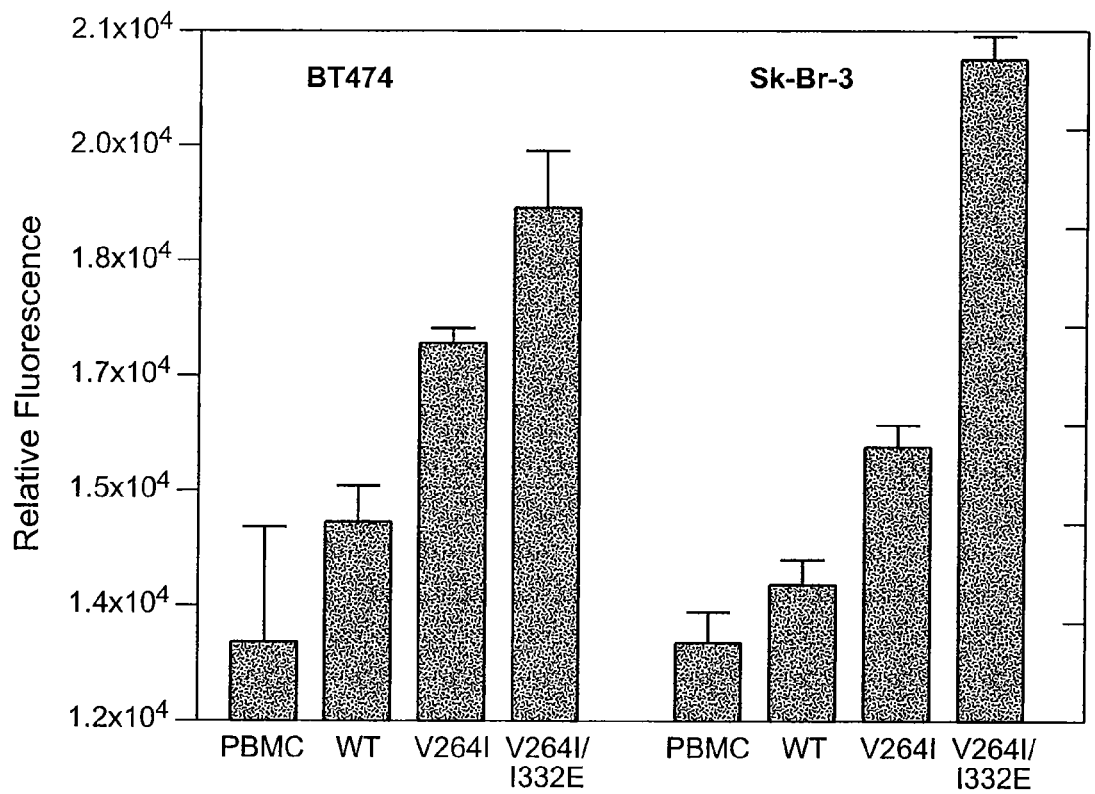
FIG._25A
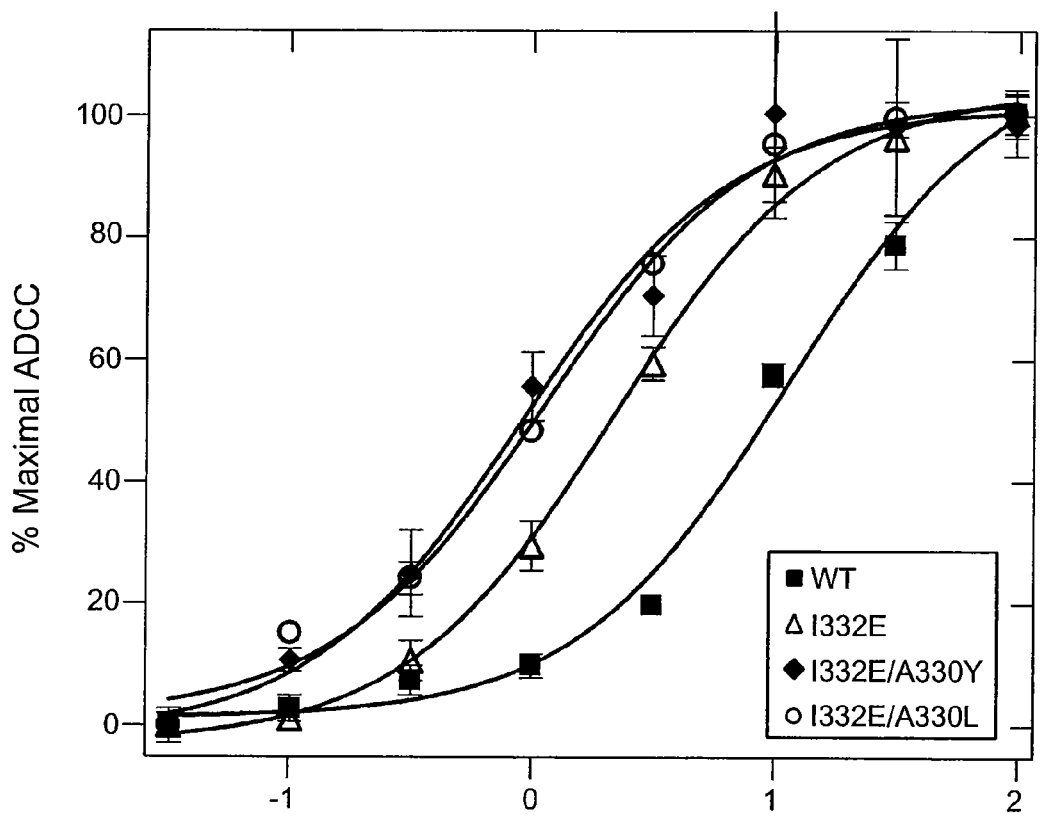
FIG._25B

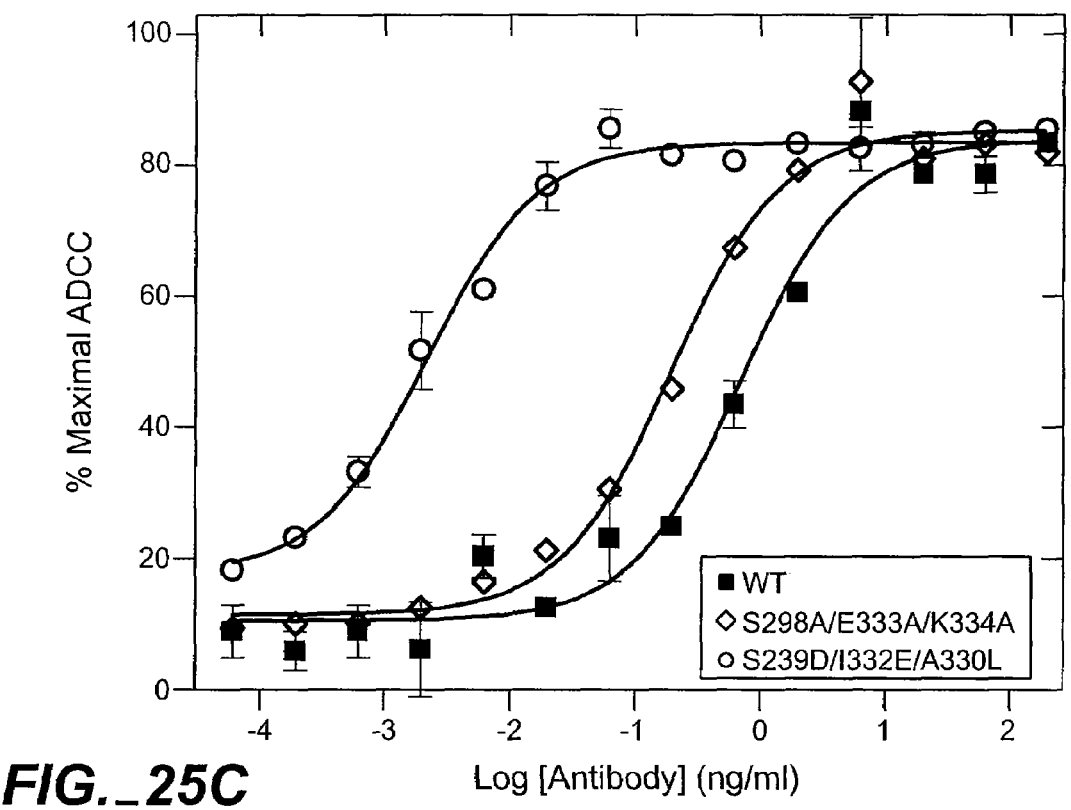
FIG._25C
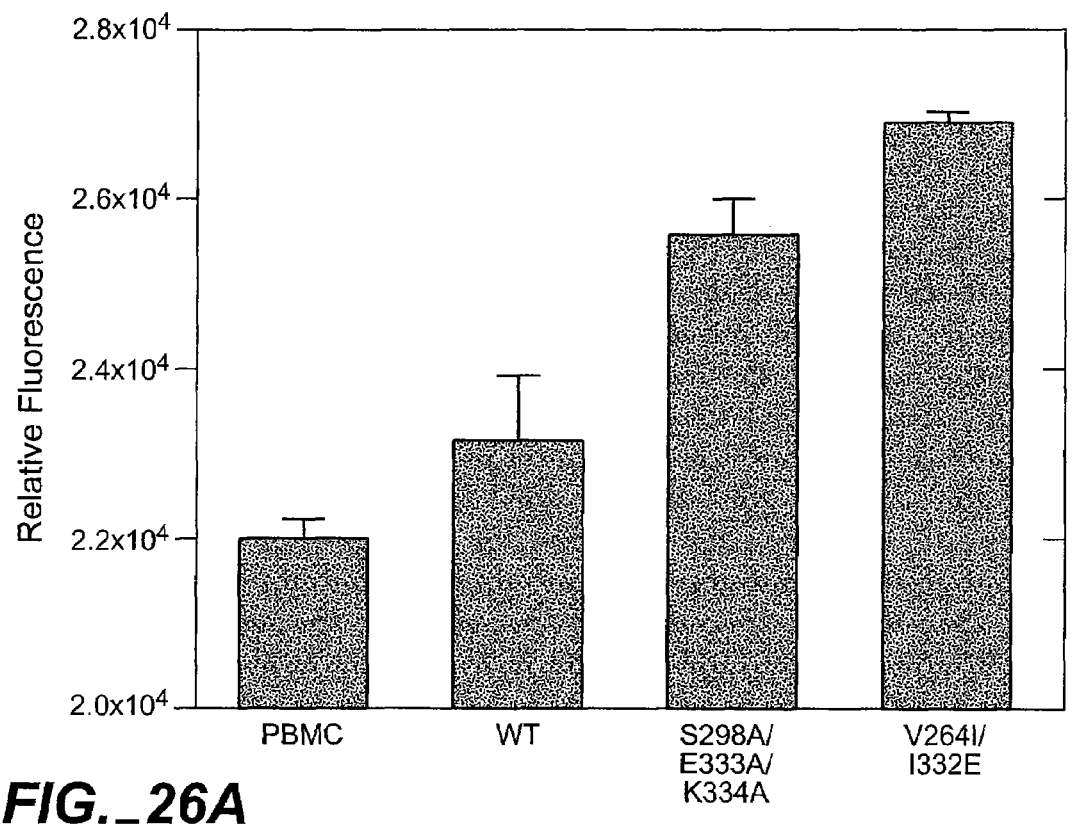
FIG._26A

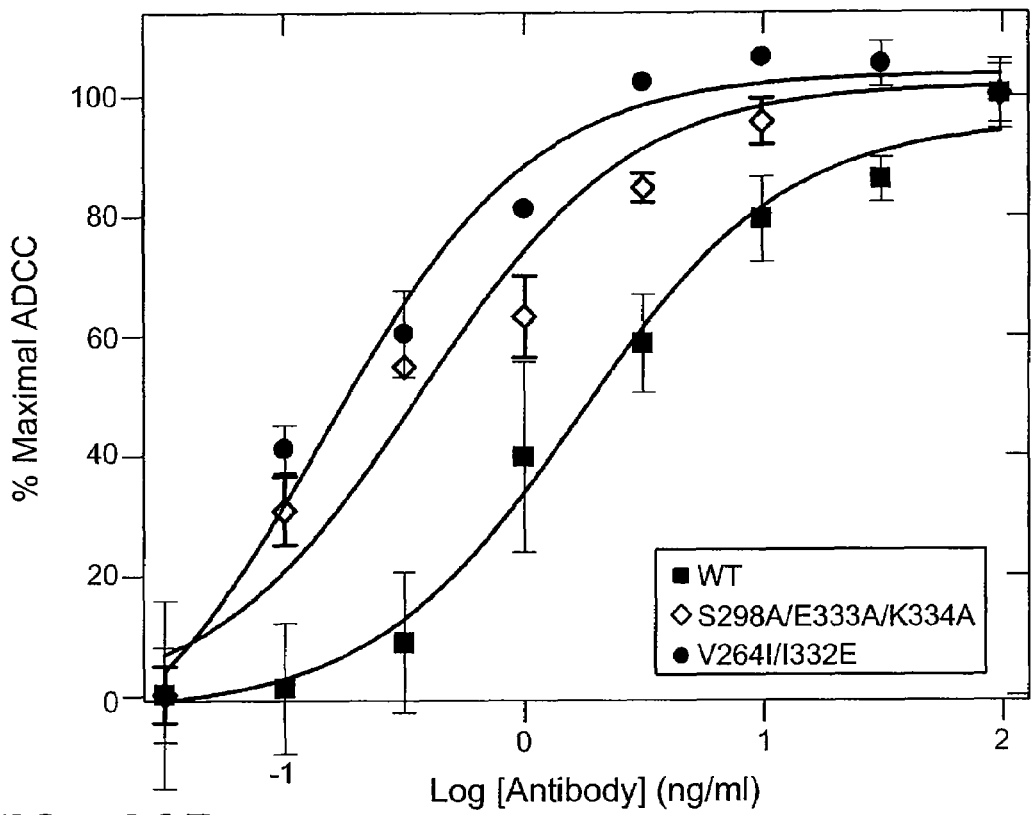
FIG._26B
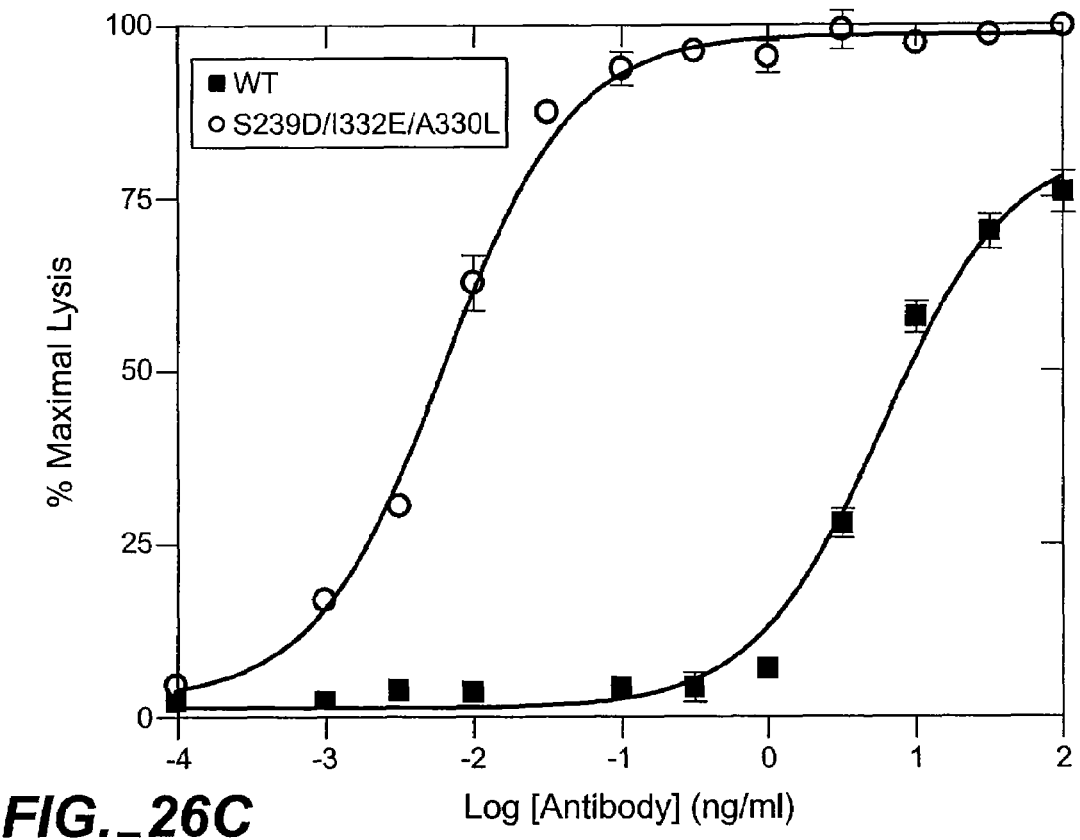
FIG._26C

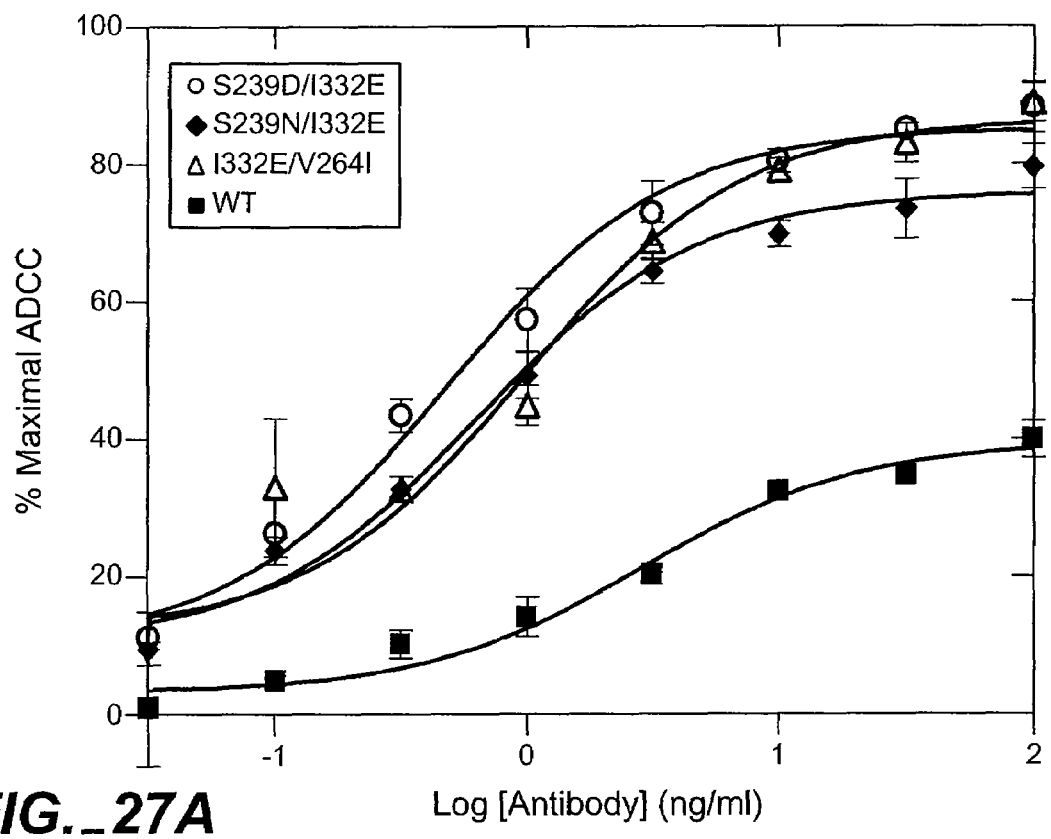
FIG._27A
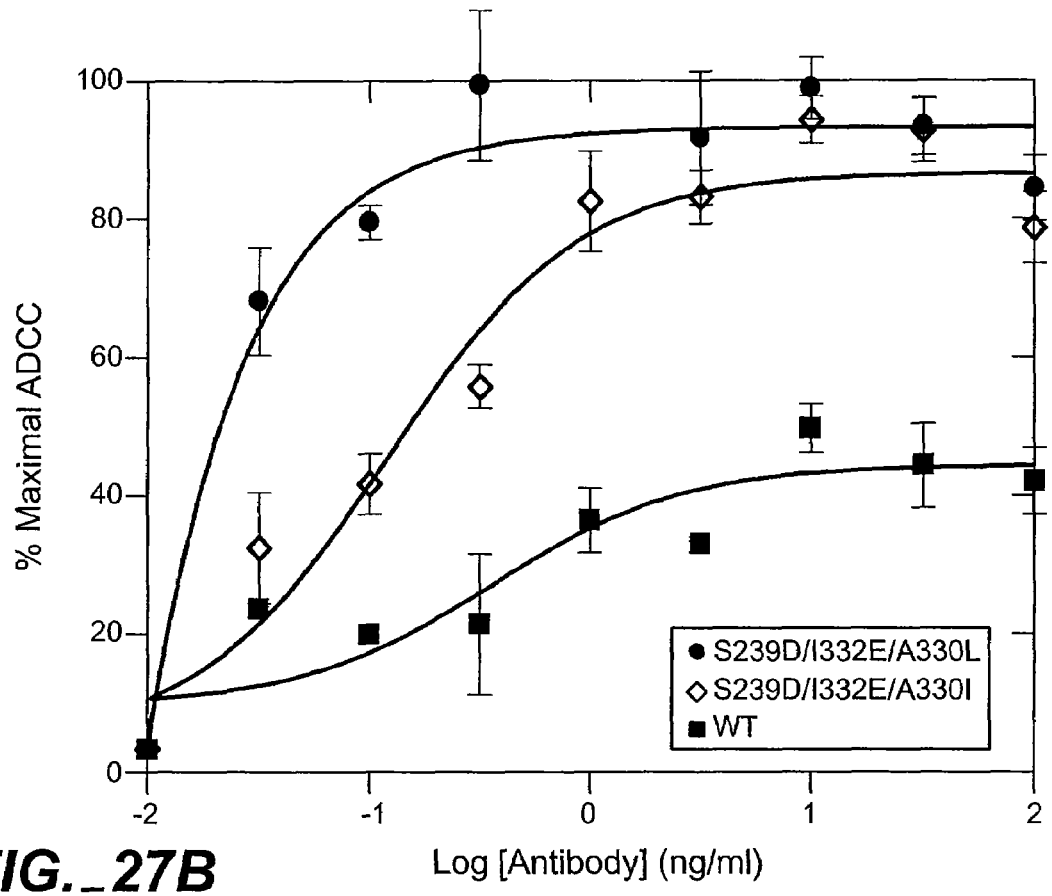
FIG._27B

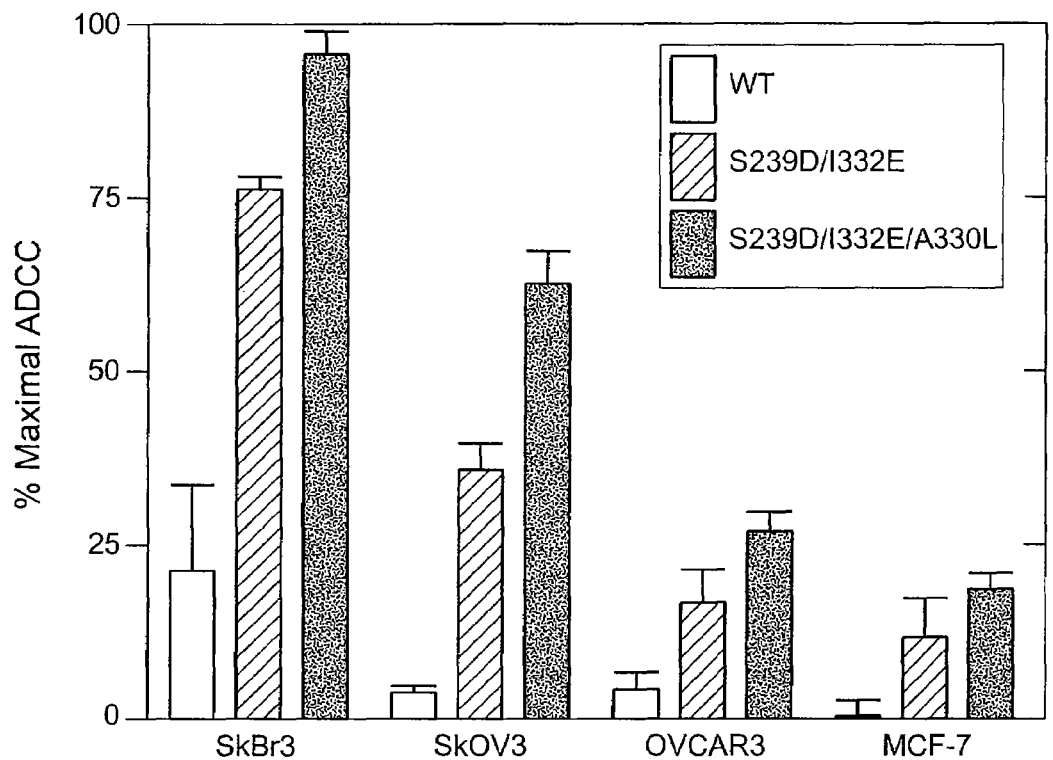
FIG._28
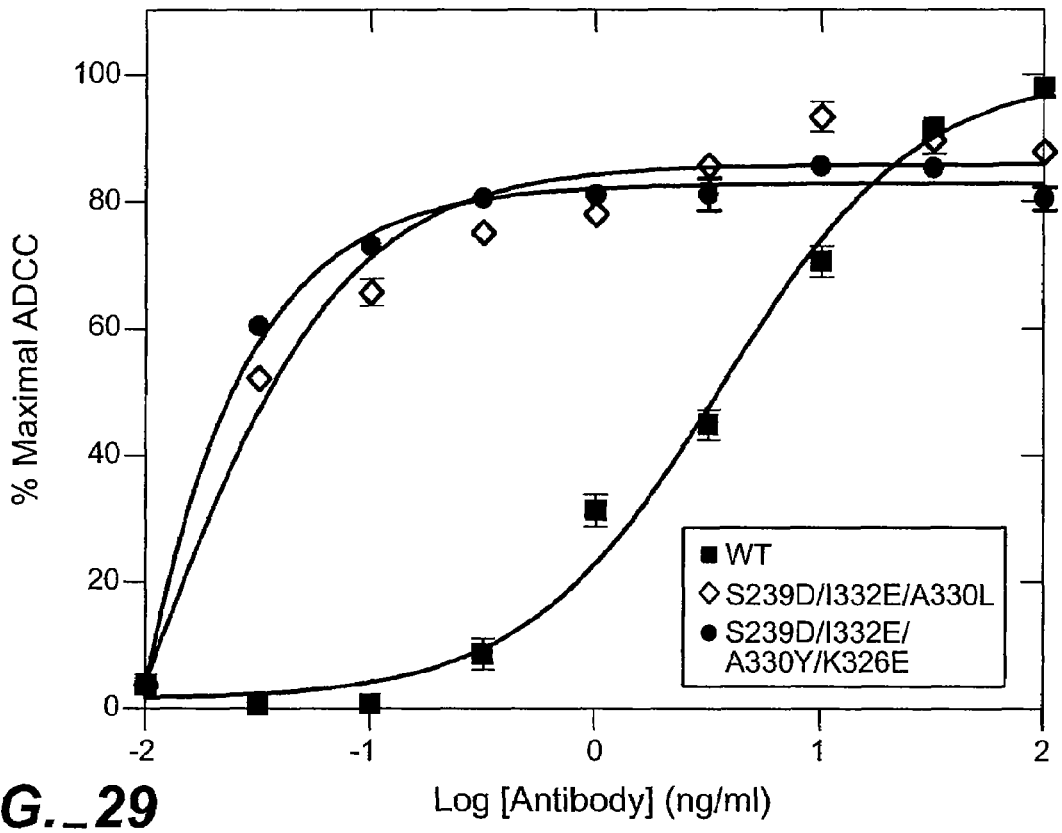
FIG._29

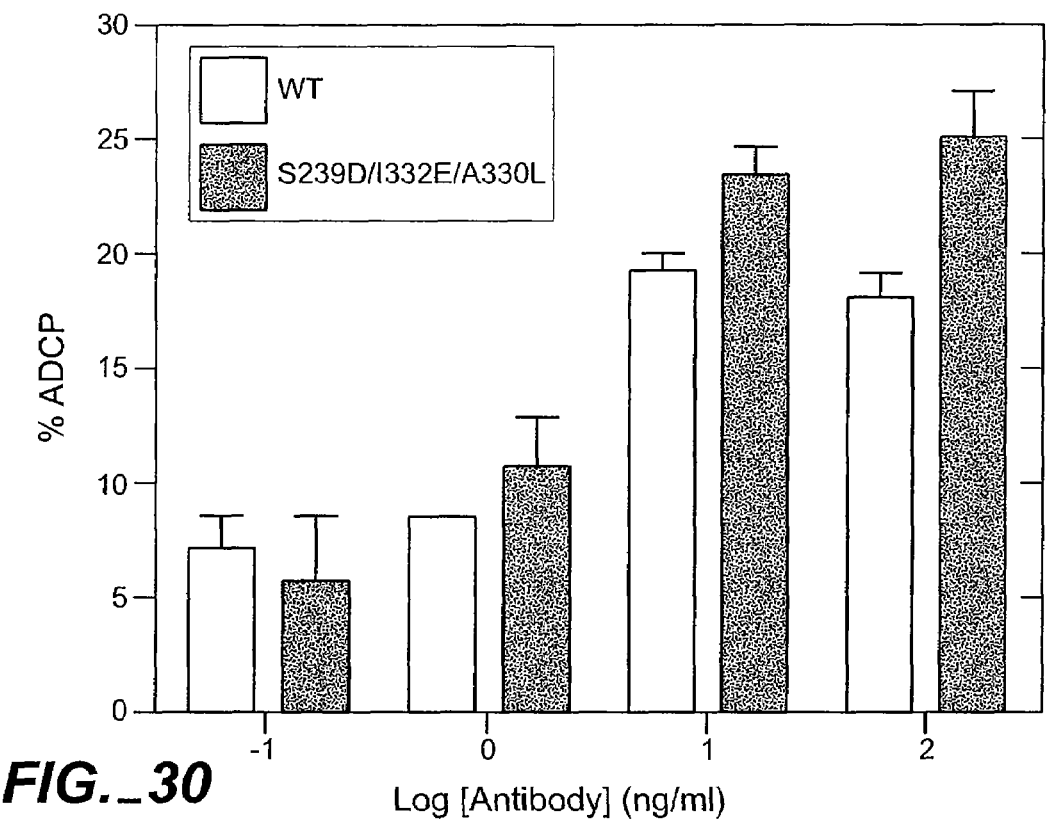
FIG._30
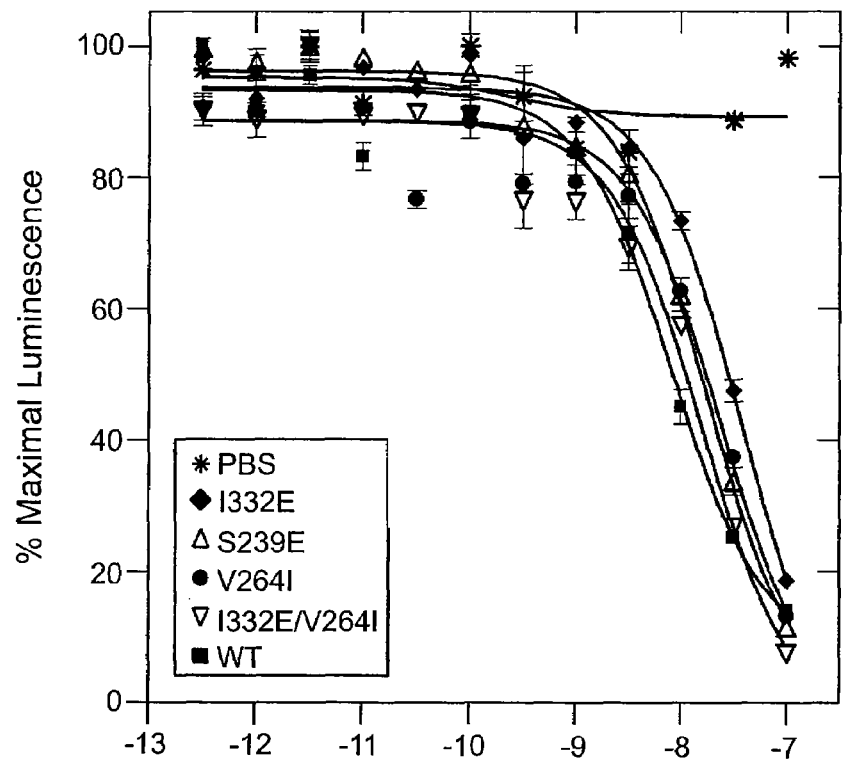
FIG._31A

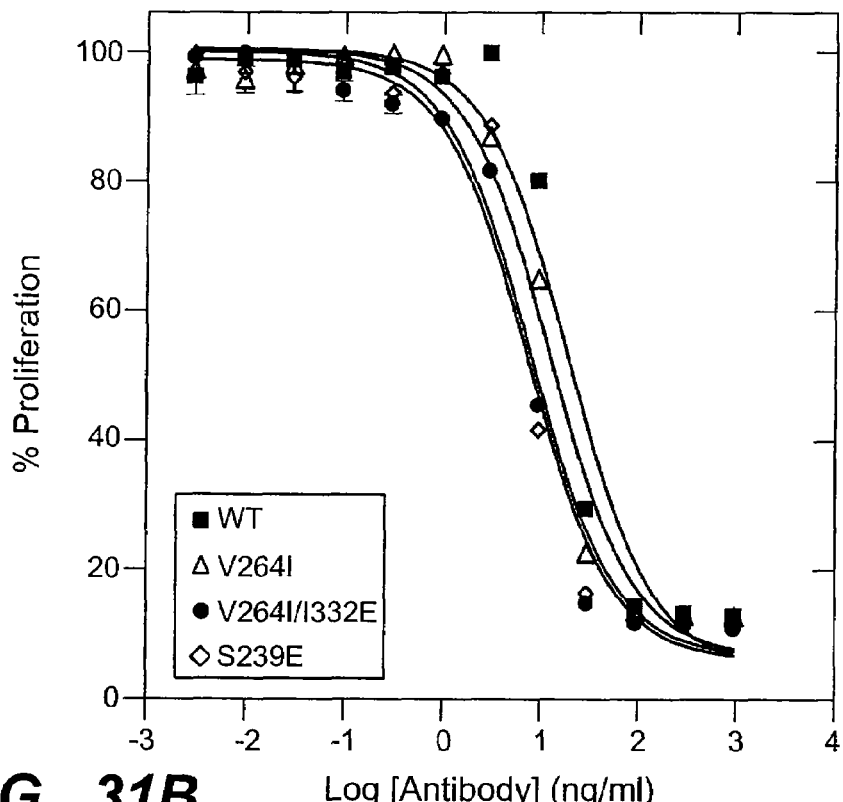
FIG._31B
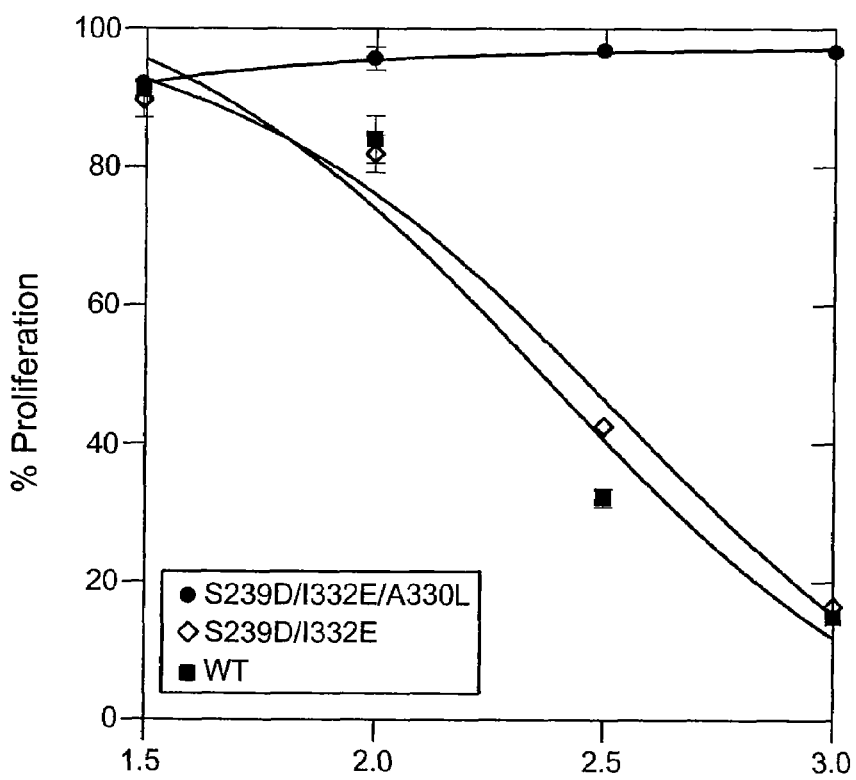
FIG._31C

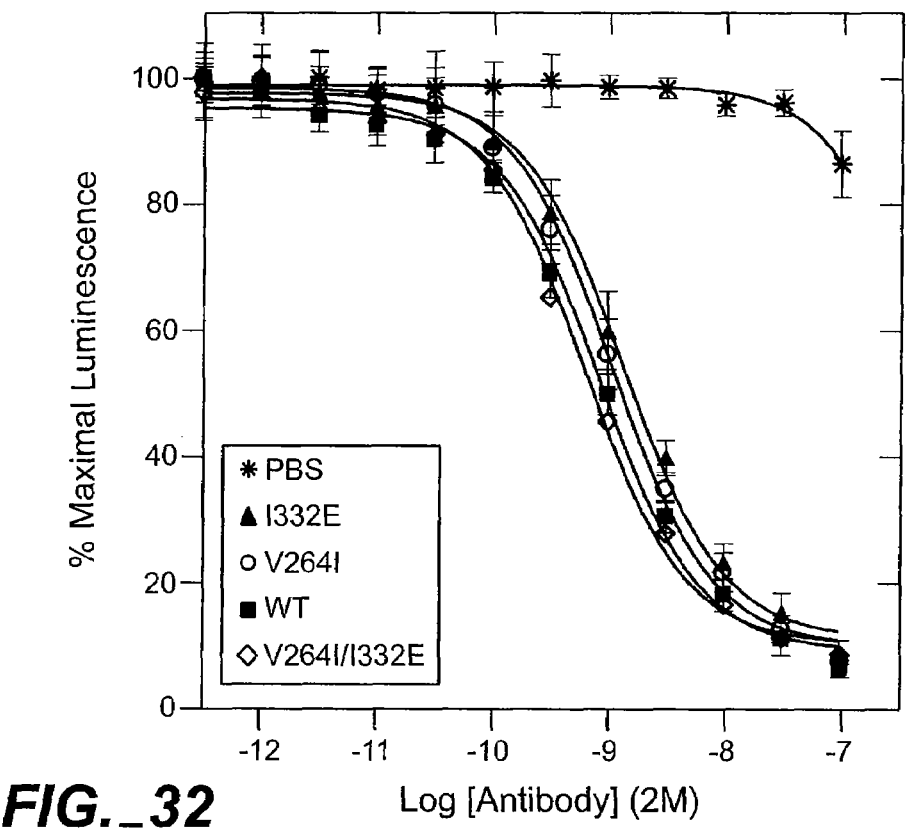
FIG._32
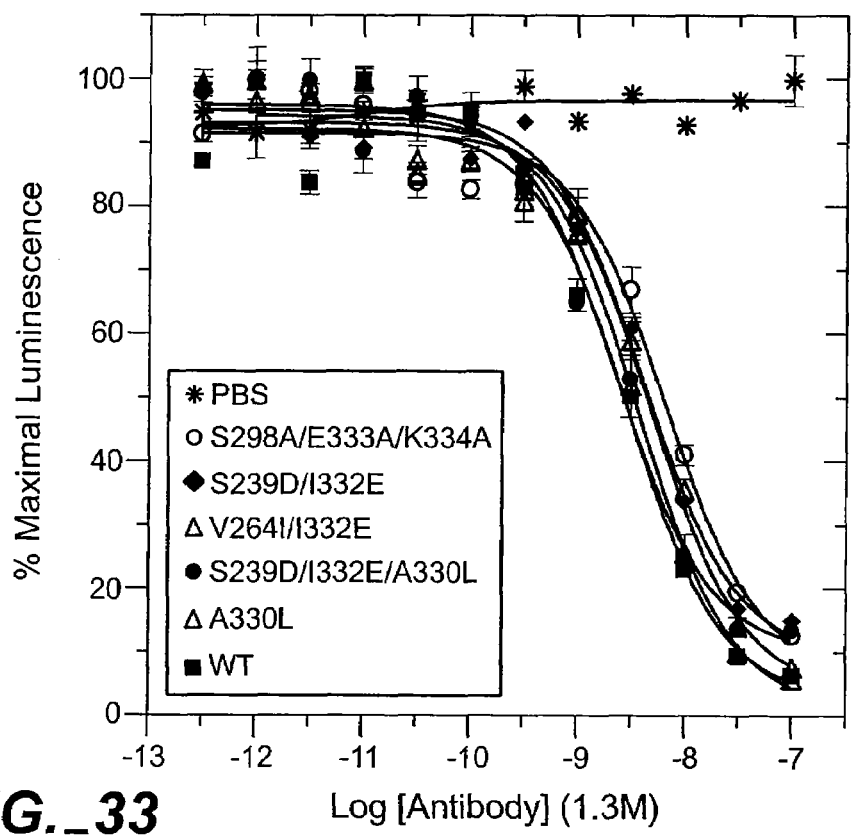
FIG._33

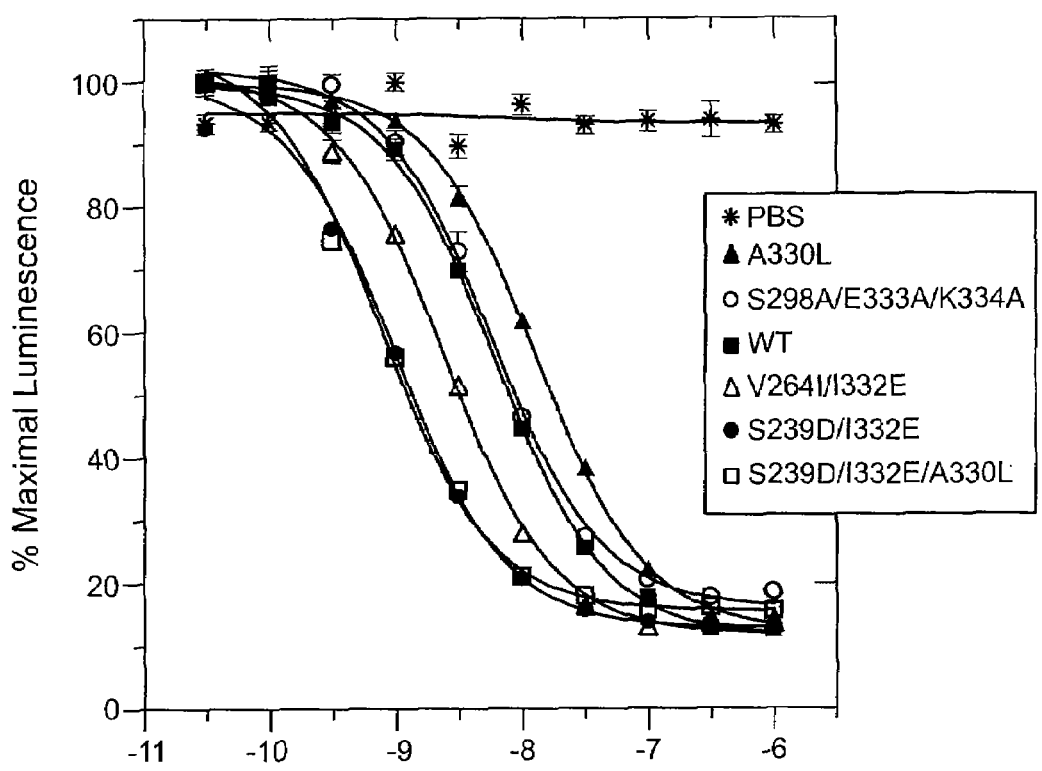
FIG._34A
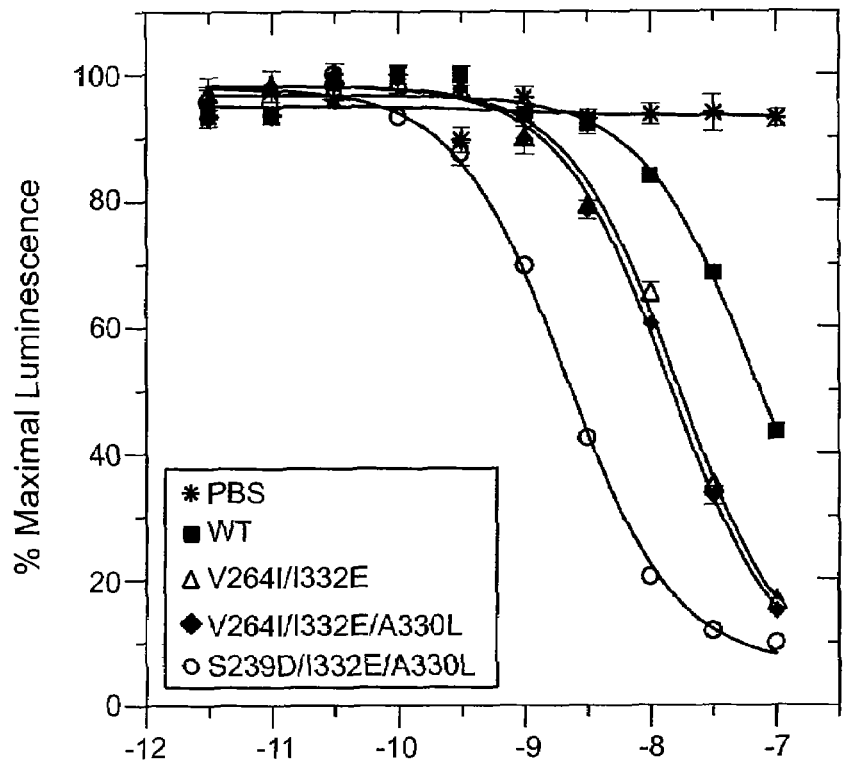
FIG._34B

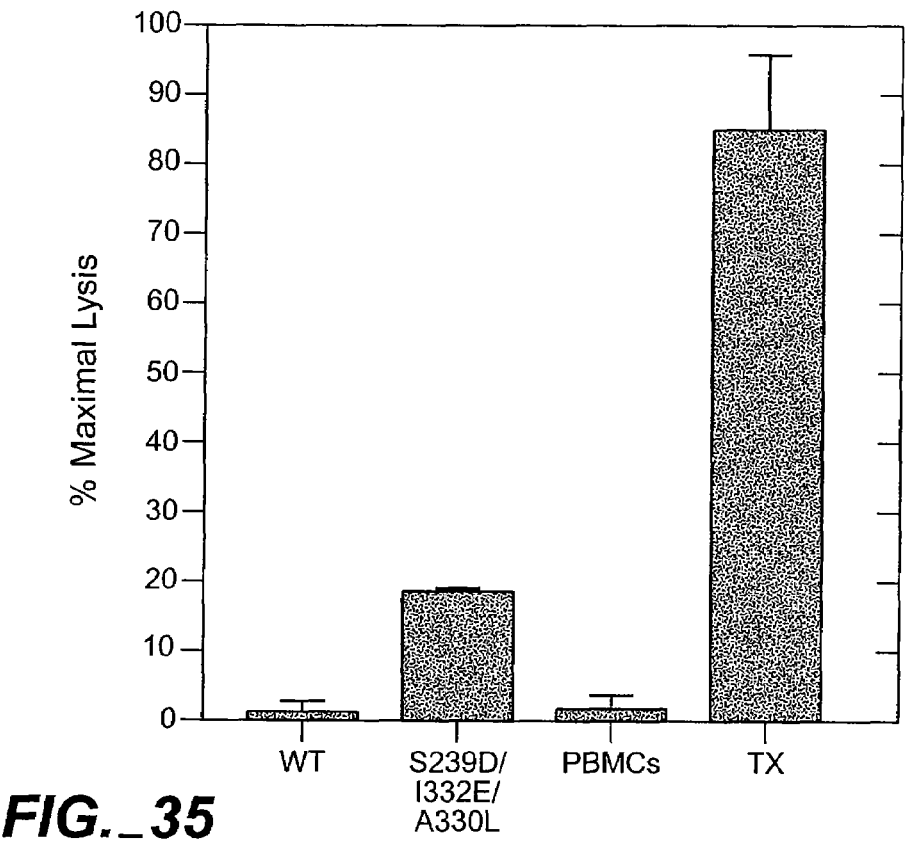
FIG._35
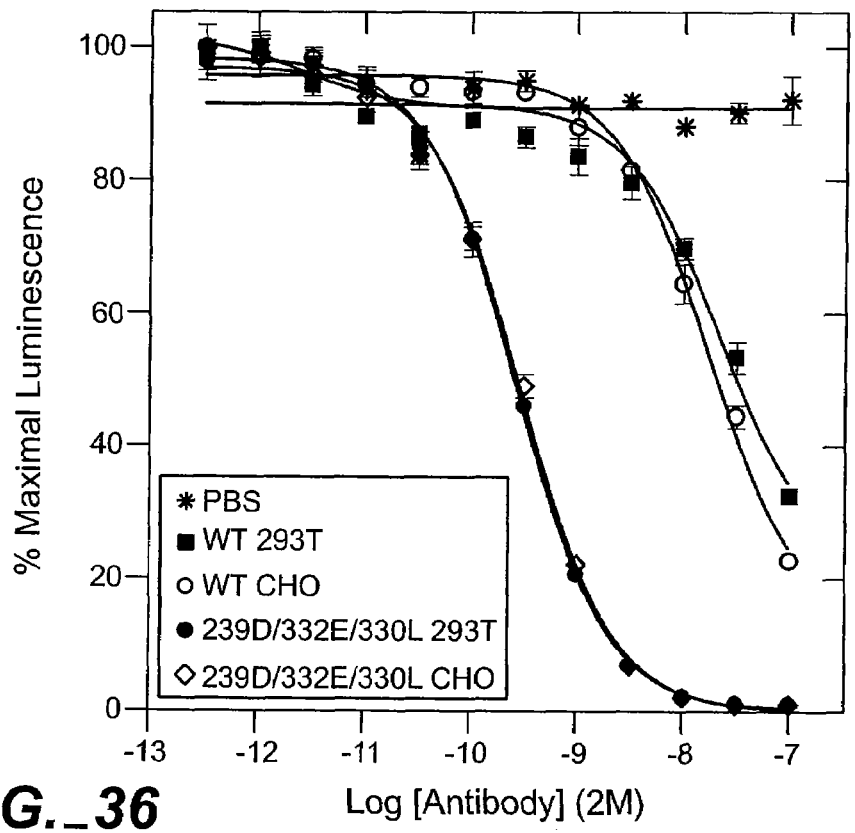
FIG._36

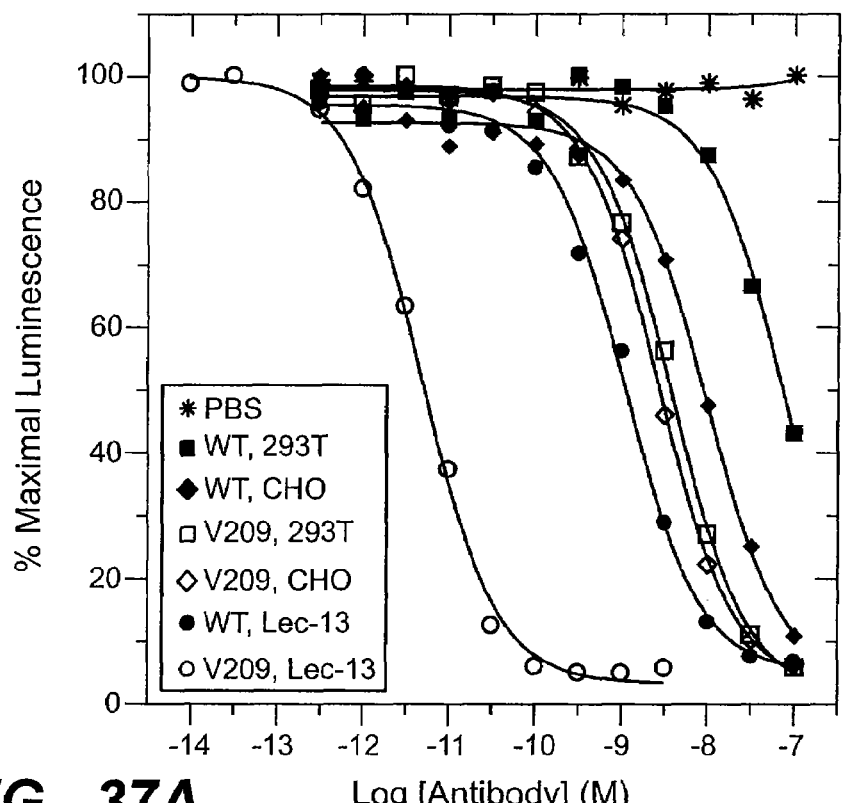
FIG._37A
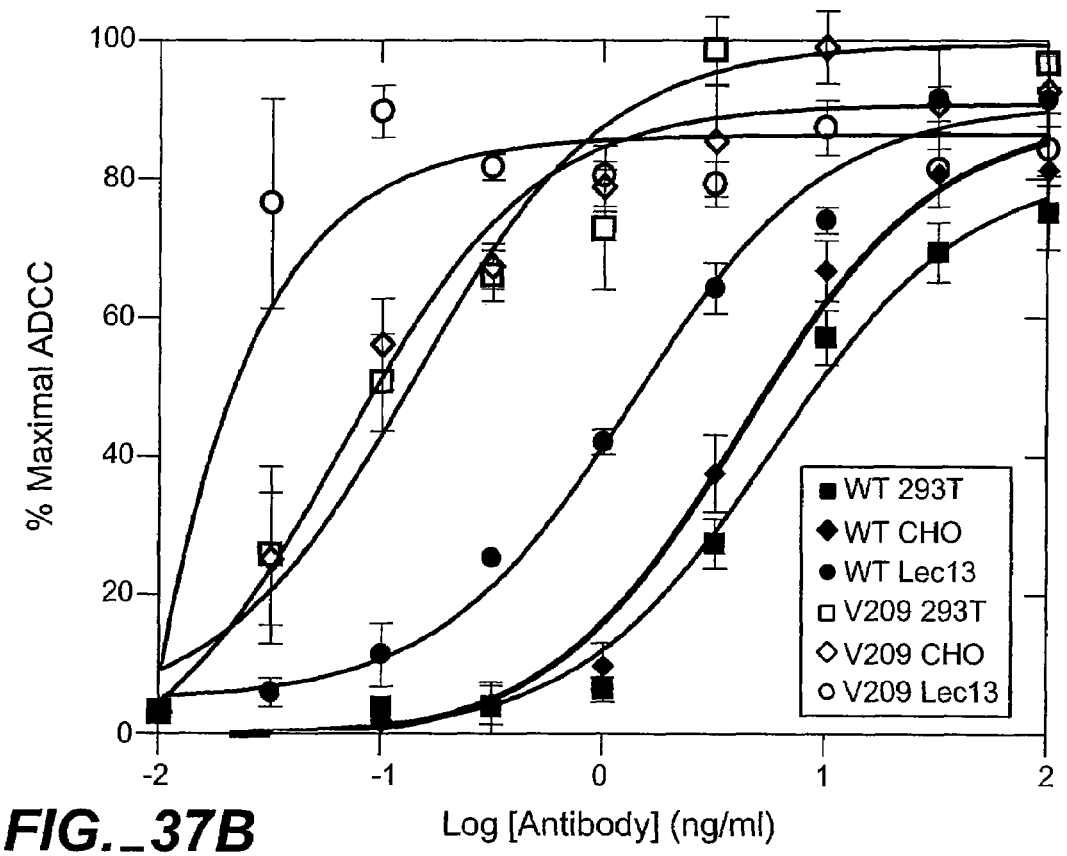
FIG._37B

SEQ ID NO: 3
Anti-CD20 Light Chain
QIVLSQSPAILSASPGEKVTMTCRASSSVSYIHWFQQKPGSSPKPWIYATSNLASGVPVRFSGSGSG
TSYSLTISRVEAEDAATYYCQQWTSNPPTFGGGTKLEIKRTVAAPSVFIFPPSDEQLKSGTASVVCL
LNNFYPREAKVQWKVDNALQSGNSQESVTEQDSKDSTYSLSSTLTLSKADYEKHKVYACEVTHQGLS
SPVTKSFNRGEC

FIG._38A

SEQ ID NO: 4
Anti-CD20 Heavy Chain
QVQLQQPGAELVKPGASVKMSCKASGYTFTSYNMHWVKQTPGRGLEWIGAIYPGNGDTSYNQKFKGK
ATLTADKSSSTAYMQLSSLTSEDSAVYYCARSTYYGGDWYFNVWGAGTTVTVSAASTKGPSVFPLAP
SSKSTSGGTAALGCLVKDYFPEPVTVSWNSGALTSGVHTFPAVLQSSGLYSLSSVVTVPSSSLGTQT
YICNVNHKPSNTKVDKKAEPKSCDKTHTCPPCPAPELLGGPSVFLFPPKPKDTLMISRTPEVTCVVV
DVSHEDPEVKFNWYVDGVEVHNAKTKPREEQYNSTYRVVSVLTVLHQDWLNGKEYKCKVSNKALPAP
IEKTISKAKGQPREPQVYTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGK

FIG._38B

SEQ ID NO: 5
Anti-CD20 Heavy Chain Comprising Possible Fc Variants
QVQLQQPGAELVKPGASVKMSCKASGYTFTSYNMHWVKQTPGRGLEWIGAIYPGNGDTSYNQKFKGK
ATLTADKSSSTAYMQLSSLTSEDSAVYYCARSTYYGGDWYFNVWGAGTTVTVSAASTKGPSVFPLAP
SSKSTSGGTAALGCLVKDYFPEPVTVSWNSGALTSGVHTFPAVLQSSGLYSLSSVVTVPSSSLGTQT
YICNVNHKPSNTKVDKKAEPKSCDKTHTCPPCPAPELLGGP$X_1X_2$FLFPPKPKDTLMISRTPEVTCV
V$X_3$DVSHEDP$X_4$V$X_5$FNWYVDGVEVHNAKTKPREEQY$X_6Z_1$TYRVVSVLTVLHQDWLNGKEYKCKVSN
$Z_2$ALP$X_7$P$X_8$EKTISKAKGQPREPQVYTLPPSRDELTKNQVSLTCLVKGFYPSDIAVEWESNGQPEN
NYKTTPPVLDSDGSFFLYSKLTVDKSRWQQGNVFSCSVMHEALHNHYTQKSLSLSPGK

| Position | WT | Possible Substitutions |
|---|---|---|
| $X_1$ | S | D, E, N, Q, T |
| $X_2$ | V | I, M |
| $X_3$ | V | I, T, Y |
| $X_4$ | E | Y |
| $X_5$ | K | E |
| $X_6$ | N | D |
| $X_7$ | A | Y, L, I |
| $X_8$ | I | D, E, N, Q |
| $Z_1$ | S | A |
| $Z_2$ | K | E, T |

FIG._38C

OPTIMIZED FC VARIANTS AND METHODS FOR THEIR GENERATION

This Application is a continuation of U.S. application Ser. No. 10/822,231, filed Mar. 26, 2004, which is a continuation-in-part of U.S. Ser. No. 10/672,280, filed Sep. 26, 2003, which claims the benefit of the filing date under 35 U.S.C. §119(e) to U.S. Ser. Nos. 60/477,839 filed Jun. 12, 2003; 60/467,606 filed May 2, 2003; 60/414,433 filed Sep. 27, 2002; and 60/442,301 filed Jan. 23, 2003, and is a continuation-in-part of U.S. Ser. No. 10/379,392, filed Mar. 3, 2003 all of which are expressly incorporated by reference in their entirety. U.S. Ser. No. 10/379,392 claims the benefit of 35 U.S.C. §119(e) to U.S. Ser. Nos. 60/384,197, filed May 29, 2002 and 60/360,843, filed Mar. 1, 2002.

FIELD OF THE INVENTION

The present invention relates to novel optimized Fc variants, engineering methods for their generation, and their application, particularly for therapeutic purposes.

BACKGROUND OF THE INVENTION

Antibodies are immunological proteins that bind a specific antigen. In most mammals, including humans and mice, antibodies are constructed from paired heavy and light polypeptide chains. Each chain is made up of individual immunoglobulin (Ig) domains, and thus the generic term immunoglobulin is used for such proteins. Each chain is made up of two distinct regions, referred to as the variable and constant regions. The light and heavy chain variable regions show significant sequence diversity between antibodies, and are responsible for binding the target antigen. The constant regions show less sequence diversity, and are responsible for binding a number of natural proteins to elicit important biochemical events. In humans there are five different classes of antibodies including IgA (which includes subclasses IgA1 and IgA2), IgD, IgE, IgG (which includes subclasses IgG1, IgG2, IgG3, and IgG4), and IgM. The distinguishing features between these antibody classes are their constant regions, although subtler differences may exist in the V region. FIG. 1 shows an IgG1 antibody, used here as an example to describe the general structural features of immunoglobulins. IgG antibodies are tetrameric proteins composed of two heavy chains and two light chains. The IgG heavy chain is composed of four immunoglobulin domains linked from N- to C-terminus in the order $V_H$-C$\gamma$1-C$\gamma$2-C$\gamma$3, referring to the heavy chain variable domain, constant gamma 1 domain, constant gamma 2 domain, and constant gamma 3 domain respectively. The IgG light chain is composed of two immunoglobulin domains linked from N- to C-terminus in the order $V_L$-$C_L$, referring to the light chain variable domain and the light chain constant domain respectively.

The variable region of an antibody contains the antigen binding determinants of the molecule, and thus determines the specificity of an antibody for its target antigen. The variable region is so named because it is the most distinct in sequence from other antibodies within the same class. The majority of sequence variability occurs in the complementarity determining regions (CDRs). There are 6 CDRs total, three each per heavy and light chain, designated $V_H$ CDR1, $V_H$ CDR2, $V_H$ CDR3, $V_L$ CDR1, $V_L$ CDR2, and $V_L$ CDR3. The variable region outside of the CDRs is referred to as the framework (FR) region. Although not as diverse as the CDRs, sequence variability does occur in the FR region between different antibodies. Overall, this characteristic architecture of antibodies provides a stable scaffold (the FR region) upon which substantial antigen binding diversity (the CDRs) can be explored by the immune system to obtain specificity for a broad array of antigens. A number of high-resolution structures are available for a variety of variable region fragments from different organisms, some unbound and some in complex with antigen. The sequence and structural features of antibody variable regions are well characterized (Morea et al., 1997, Biophys Chem 68:9-16; Morea et al., 2000, Methods 20:267-279), and the conserved features of antibodies have enabled the development of a wealth of antibody engineering techniques (Maynard et al., 2000, Annu Rev Biomed Eng 2:339-376). For example, it is possible to graft the CDRs from one antibody, for example a murine antibody, onto the framework region of another antibody, for example a human antibody. This process, referred to in the art as "humanization", enables generation of less immunogenic antibody therapeutics from nonhuman antibodies. Fragments comprising the variable region can exist in the absence of other regions of the antibody, including for example the antigen binding fragment (Fab) comprising $V_H$-C$\gamma$1 and $V_H$-CL, the variable fragment (Fv) comprising $V_H$ and $V_L$, the single chain variable fragment (scFv) comprising $V_H$ and $V_L$ linked together in the same chain, as well as a variety of other variable region fragments (Little et al., 2000, Immunol Today 21:364-370).

The Fc region of an antibody interacts with a number of Fc receptors and ligands, imparting an array of important functional capabilities referred to as effector functions. For IgG the Fc region, as shown in FIG. 1, comprises Ig domains C$\gamma$2 and C$\gamma$3 and the N-terminal hinge leading into C$\gamma$2. An important family of Fc receptors for the IgG class are the Fc gamma receptors (Fc$\gamma$Rs). These receptors mediate communication between antibodies and the cellular arm of the immune system (Raghavan et al., 1996, Annu Rev Cell Dev Biol 12:181-220; Ravetch et al., 2001, Annu Rev Immunol 19:275-290). In humans this protein family includes Fc$\gamma$RI (CD64), including isoforms Fc$\gamma$RIa, Fc$\gamma$RIb, and Fc$\gamma$RIc; Fc$\gamma$RII (CD32), including isoforms Fc$\gamma$RIIa (including allotypes H131 and R131), Fc$\gamma$RIIb (including Fc$\gamma$RIIb-1 and Fc$\gamma$RIIb-2), and Fc$\gamma$RIIc; and Fc$\gamma$RIII (CD16), including isoforms Fc$\gamma$RIIIa (including allotypes V158 and F158) and Fc$\gamma$RIIIb (including allotypes Fc$\gamma$RIIIb-NA1 and Fc$\gamma$RIIIb-NA2) (Jefferis et al., 2002, Immunol Lett 82:57-65). These receptors typically have an extracellular domain that mediates binding to Fc, a membrane spanning region, and an intracellular domain that may mediate some signaling event within the cell. These receptors are expressed in a variety of immune cells including monocytes, macrophages, neutrophils, dendritic cells, eosinophils, mast cells, platelets, B cells, large granular lymphocytes, Langerhans' cells, natural killer (NK) cells, and $\gamma\gamma$ T cells. Formation of the Fc/Fc$\gamma$R complex recruits these effector cells to sites of bound antigen, typically resulting in signaling events within the cells and important subsequent immune responses such as release of inflammation mediators, B cell activation, endocytosis, phagocytosis, and cytotoxic attack. The ability to mediate cytotoxic and phagocytic effector functions is a potential mechanism by which antibodies destroy targeted cells. The cell-mediated reaction wherein nonspecific cytotoxic cells that express Fc$\gamma$Rs recognize bound antibody on a target cell and subsequently cause lysis of the target cell is referred to as antibody dependent cell-mediated cytotoxicity (ADCC) (Raghavan et al., 1996, Annu Rev Cell Dev Biol 12:181-220; Ghetie et al., 2000, Annu Rev Immunol 18:739-766; Ravetch et al., 2001, Annu Rev Immunol 19:275-290). The cell-mediated reaction wherein nonspecific cytotoxic cells that express Fc$\gamma$Rs recognize bound antibody on a target cell and subsequently cause phagocytosis of the target cell is referred to as antibody dependent cell-mediated phagocytosis (ADCP). A number of structures have been solved of the extracellular domains of human FcγRs, including FcγRIIa (pdb accession code 1H9V)(Sondermann et al., 2001, *J Mol Biol* 309:737-749) (pdb accession code 1FCG)(Maxwell et al., 1999, *Nat Struct Biol* 6:437-442), FcγRIIb (pdb accession code 2FCB)(Sondermann et al., 1999, *Embo J* 18:1095-1103); and FcγRIIIb (pdb accession code 1 E4J)(Sondermann et al., 2000, *Nature* 406:267-273.). All FcγRs bind the same region on Fc, at the N-terminal end of the Cγ2 domain and the preceding hinge, shown in FIG. 2. This interaction is well characterized structurally (Sondermann et al., 2001, *J Mol Biol* 309:737-749), and several structures of the human Fc bound to the extracellular domain of human FcγRIIIb have been solved (pdb accession code 1E4K)(Sondermann et al., 2000, *Nature* 406:267-273.) (pdb accession codes 1IIS and 1IIX)(Radaev et al., 2001, *J Biol Chem* 276:16469-16477), as well as has the structure of the human IgE Fc/FcεRIα complex (pdb accession code 1F6A)(Garman et al., 2000, *Nature* 406:259-266).

The different IgG subclasses have different affinities for the FcγRs, with IgG1 and IgG3 typically binding substantially better to the receptors than IgG2 and IgG4 (Jefferis et al., 2002, *Immunol Lett* 82:57-65). All FcγRs bind the same region on IgG Fc, yet with different affinities: the high affinity binder FcγRI has a Kd for IgG1 of $10^{-8}$ $M^{-1}$, whereas the low affinity receptors FcγRII and FcγRIII generally bind at $10^{-6}$ and $10^{-5}$ respectively. The extracellular domains of FcγRIIIa and FcγRIIIb are 96% identical, however FcγRIIIb does not have a intracellular signaling domain. Furthermore, whereas FcγRI, FcγRIIa/c, and FcγRIIIa are positive regulators of immune complex-triggered activation, characterized by having an intracellular domain that has an immunoreceptor tyrosine-based activation motif (ITAM), FcγRIIb has an immunoreceptor tyrosine-based inhibition motif (ITIM) and is therefore inhibitory. Thus the former are referred to as activation receptors, and FcγRIIb is referred to as an inhibitory receptor. The receptors also differ in expression pattern and levels on different immune cells. Yet another level of complexity is the existence of a number of FcγR polymorphisms in the human proteome. A particularly relevant polymorphism with clinical significance is V158/F158 FcγRIIIa. Human IgG1 binds with greater affinity to the V158 allotype than to the F158 allotype. This difference in affinity, and presumably its effect on ADCC and/or ADCP, has been shown to be a significant determinant of the efficacy of the anti-CD20 antibody rituximab (Rituxan®, a registered trademark of IDEC Pharmaceuticals Corporation). Patients with the V158 allotype respond favorably to rituximab treatment; however, patients with the lower affinity F158 allotype respond poorly (Cartron et al., 2002, *Blood* 99:754-758). Approximately 10-20% of humans are V158/V158 homozygous, 45% are V158/F158 heterozygous, and 35-45% of humans are F158/F158 homozygous (Lehrnbecher et al., 1999, *Blood* 94:4220-4232; Cartron et al., 2002, *Blood* 99:754-758). Thus 80-90% of humans are poor responders, that is they have at least one allele of the F158 FcγRIIIa.

An overlapping but separate site on Fc, shown in FIG. 1, serves as the interface for the complement protein C1q. In the same way that Fc/FcγR binding mediates ADCC, Fc/C1q binding mediates complement dependent cytotoxicity (CDC). C1q forms a complex with the serine proteases C1r and C1s to form the C1 complex. C1q is capable of binding six antibodies, although binding to two IgGs is sufficient to activate the complement cascade. Similar to Fc interaction with FcγRs, different IgG subclasses have different affinity for C1q, with IgG1 and IgG3 typically binding substantially better to the FcγRs than IgG2 and IgG4 (Jefferis et al., 2002, *Immunol Lett* 82:57-65). There is currently no structure available for the Fc/C1 q complex; however, mutagenesis studies have mapped the binding site on human IgG for C1q to a region involving residues D270, K322, K326, P329, and P331, and E333 (Idusogie et al., 2000, *J Immunol* 164:4178-4184; Idusogie et al., 2001, *J Immunol* 166:2571-2575).

A site on Fc between the Cγ2 and Cγ3 domains, shown in FIG. 1, mediates interaction with the neonatal receptor FcRn, the binding of which recycles endocytosed antibody from the endosome back to the bloodstream (Raghavan et al., 1996, *Annu Rev Cell Dev Biol* 12:181-220; Ghetie et al., 2000, *Annu Rev Immunol* 18:739-766). This process, coupled with preclusion of kidney filtration due to the large size of the full length molecule, results in favorable antibody serum half-lives ranging from one to three weeks. Binding of Fc to FcRn also plays a key role in antibody transport. The binding site for FcRn on Fc is also the site at which the bacterial proteins A and G bind. The tight binding by these proteins is typically exploited as a means to purify antibodies by employing protein A or protein G affinity chromatography during protein purification. Thus the fidelity of this region on Fc is important for both the clinical properties of antibodies and their purification. Available structures of the rat Fc/FcRn complex (Martin et al., 2001, *Mol Cell* 7:867-877), and of the complexes of Fc with proteins A and G (Deisenhofer, 1981, *Biochemistry* 20:2361-2370; Sauer-Eriksson et al., 1995, *Structure* 3:265-278; Tashiro et al., 1995, *Curr Opin Struct Biol* 5:471-481) provide insight into the interaction of Fc with these proteins.

A key feature of the Fc region is the conserved N-linked glycosylation that occurs at N297, shown in FIG. 1. This carbohydrate, or oligosaccharide as it is sometimes referred, plays a critical structural and functional role for the antibody, and is one of the principle reasons that antibodies must be produced using mammalian expression systems. While not wanting to be limited to one theory, it is believed that the structural purpose of this carbohydrate may be to stabilize or solubilize Fc, determine a specific angle or level of flexibility between the Cγ3 and Cγ2 domains, keep the two Cγ2 domains from aggregating with one another across the central axis, or a combination of these. Efficient Fc binding to FcγR and C1q requires this modification, and alterations in the composition of the N297 carbohydrate or its elimination affect binding to these proteins (Umaña et al., 1999, *Nat Biotechnol* 17:176-180; Davies et al., 2001, *Biotechnol Bioeng* 74:288-294; Mimura et al., 2001, *J Biol Chem* 276:45539-45547; Radaev et al., 2001, *J Biol Chem* 276:16478-16483; Shields et al., 2001, *J Biol Chem* 276:6591-6604; Shields et al., 2002, *J Biol Chem* 277:26733-26740; Simmons et al., 2002, *J Immunol Methods* 263:133-147). Yet the carbohydrate makes little if any specific contact with FcγRs (Radaev et al., 2001, *J Biol Chem* 276:16469-16477), indicating that the functional role of the N297 carbohydrate in mediating Fc/FcγR binding may be via the structural role it plays in determining the Fc conformation. This is supported by a collection of crystal structures of four different Fc glycoforms, which show that the composition of the oligosaccharide impacts the conformation of Cγ2 and as a result the Fc/FcγR interface (Krapp et al., 2003, *J Mol Biol* 325:979-989).

The features of antibodies discussed above—specificity for target, ability to mediate immune effector mechanisms, and long half-life in serum—make antibodies powerful therapeutics. Monoclonal antibodies are used therapeutically for the treatment of a variety of conditions including cancer, inflammation, and cardiovascular disease. There are currently over ten antibody products on the market and hundreds in development. In addition to antibodies, an antibody-like protein that is finding an expanding role in research and therapy is the Fc fusion (Chamow et al., 1996, *Trends Biotechnol* 14:52-60; Ashkenazi et al., 1997, *Curr Opin Immunol* 9:195-200). An Fc fusion is a protein wherein one or more polypeptides is operably linked to Fc. An Fc fusion combines the Fc region of an antibody, and thus its favorable effector functions and pharmacokinetics, with the target-binding region of a receptor, ligand, or some other protein or protein domain. The role of the latter is to mediate target recognition, and thus it is functionally analogous to the antibody variable region. Because of the structural and functional overlap of Fc fusions with antibodies, the discussion on antibodies in the present invention extends directly to Fc fusions.

Despite such widespread use, antibodies are not optimized for clinical use. Two significant deficiencies of antibodies are their suboptimal anticancer potency and their demanding production requirements. These deficiencies are addressed by the present invention There are a number of possible mechanisms by which antibodies destroy tumor cells, including anti-proliferation via blockage of needed growth pathways, intracellular signaling leading to apoptosis, enhanced down regulation and/or turnover of receptors, CDC, ADCC, ADCP, and promotion of an adaptive immune response (Cragg et al., 1999, *Curr Opin Immunol* 11:541-547; Glennie et al., 2000, *Immunol Today* 21:403-410). Anti-tumor efficacy may be due to a combination of these mechanisms, and their relative importance in clinical therapy appears to be cancer dependent. Despite this arsenal of anti-tumor weapons, the potency of antibodies as anti-cancer agents is unsatisfactory, particularly given their high cost. Patient tumor response data show that monoclonal antibodies provide only a small improvement in therapeutic success over normal single-agent cytotoxic chemotherapeutics. For example, just half of all relapsed low-grade non-Hodgkin's lymphoma patients respond to the anti-CD20 antibody rituximab (McLaughlin et al., 1998, *J Clin Oncol* 16:2825-2833). Of 166 clinical patients, 6% showed a complete response and 42% showed a partial response, with median response duration of approximately 12 months. Trastuzumab (Herceptin®, a registered trademark of Genentech), an anti-HER2/neu antibody for treatment of metastatic breast cancer, has less efficacy. The overall response rate using trastuzumab for the 222 patients tested was only 15%, with 8 complete and 26 partial responses and a median response duration and survival of 9 to 13 months (Cobleigh et al., 1999, *J Clin Oncol* 17:2639-2648). Currently for anticancer therapy, any small improvement in mortality rate defines success. Thus there is a significant need to enhance the capacity of antibodies to destroy targeted cancer cells.

A promising means for enhancing the anti-tumor potency of antibodies is via enhancement of their ability to mediate cytotoxic effector functions such as ADCC, ADCP, and CDC. The importance of FcγR-mediated effector functions for the anti-cancer activity of antibodies has been demonstrated in mice (Clynes et al., 1998, *Proc Natl Acad Sci USA* 95:652-656; Clynes et al., 2000, *Nat Med* 6:443-446), and the affinity of interaction between Fc and certain FcγRs correlates with targeted cytotoxicity in cell-based assays (Shields et al., 2001, *J Biol Chem* 276:6591-6604; Presta et al., 2002, *Biochem Soc Trans* 30:487-490; Shields et al., 2002, *J Biol Chem* 277:26733-26740). Additionally, a correlation has been observed between clinical efficacy in humans and their allotype of high (V158) or low (F158) affinity polymorphic forms of FcγRIIIa (Cartron et al., 2002, *Blood* 99:754-758). Together these data suggest that an antibody with an Fc region optimized for binding to certain FcγRs may better mediate effector functions and thereby destroy cancer cells more effectively in patients. The balance between activating and inhibiting receptors is an important consideration, and optimal effector function may result from an Fc with enhanced affinity for activation receptors, for example FcγRI, FcγRIIa/c, and FcγRIIIa, yet reduced affinity for the inhibitory receptor FcγRIIb. Furthermore, because FcγRs can mediate antigen uptake and processing by antigen presenting cells, enhanced Fc/FcγR affinity may also improve the capacity of antibody therapeutics to elicit an adaptive immune response.

Mutagenesis studies have been carried out on Fc towards various goals, with substitutions typically made to alanine (referred to as alanine scanning) or guided by sequence homology substitutions (Duncan et al., 1988, *Nature* 332:563-564; Lund et al., 1991, *J Immunol* 147:2657-2662; Lund et al., 1992, *Mol Immunol* 29:53-59; Jefferis et al., 1995, *Immunol Lett* 44:111-117; Lund et al., 1995, *Faseb J* 9:115-119; Jefferis et al., 1996, *Immunol Lett* 54:101-104; Lund et al., 1996, *J Immunol* 157:4963-4969; Armour et al., 1999, *Eur J Immunol* 29:2613-2624; Shields et al., 2001, *J Biol Chem* 276:6591-6604; Jefferis et al., 2002, *Immunol Lett* 82:57-65) (U.S. Pat. No. 5,624,821; U.S. Pat. No. 5,885,573; PCT WO 00/42072; PCT WO 99/58572). The majority of substitutions reduce or ablate binding with FcγRs. However some success has been achieved at obtaining Fc variants with higher FcγR affinity. (See for example U.S. Pat. No. 5,624,821, and PCT WO 00/42072). For example, Winter and colleagues substituted the human amino acid at position 235 of mouse IgG2b antibody (a glutamic acid to leucine mutation) that increased binding of the mouse antibody to human FcγRI by 100-fold (Duncan et al., 1988, *Nature* 332:563-564) (U.S. Pat. No. 5,624,821). Shields et al. used alanine scanning mutagenesis to map Fc residues important to FcγR binding, followed by substitution of select residues with non-alanine mutations (Shields et al., 2001, *J Biol Chem* 276:6591-6604; Presta et al., 2002, *Biochem Soc Trans* 30:487-490) (PCT WO 00/42072). Several mutations disclosed in this study, including S298A, E333A, and K334A, show enhanced binding to the activating receptor FcγRIIIa and reduced binding to the inhibitory receptor FcγRIIb. These mutations were combined to obtain double and triple mutation variants that show additive improvements in binding. The best variant disclosed in this study is a S298A/E333A/K334A triple mutant with approximately a 1.7-fold increase in binding to F158 FcγRIIIa, a 5-fold decrease in binding to FcγRIIb, and a 2.1-fold enhancement in ADCC.

Enhanced affinity of Fc for FcγR has also been achieved using engineered glycoforms generated by expression of antibodies in engineered or variant cell lines (Umaña et al., 1999, *Nat Biotechnol* 17:176-180; Davies et al., 2001, *Biotechnol Bioeng* 74:288-294; Shields et al., 2002, *J Biol Chem* 277:26733-26740; Shinkawa et al., 2003, *J Biol Chem* 278:3466-3473). This approach has generated substantial enhancements of the capacity of antibodies to bind FcγRIIIa and to mediate ADCC. Although there are practical limitations such as the growth efficiency of the expression strains under large scale production conditions, this approach for enhancing Fc/FcγR affinity and effector function is promising. Indeed, coupling of these alternate glycoform technologies with the Fc variants of the present invention may provide additive or synergistic effects for optimal effector function.

Although there is a need for greater effector function, for some antibody therapeutics reduced or eliminated effector function may be desired. This is often the case for therapeutic antibodies whose mechanism of action involves blocking or antagonism but not killing of the cells bearing target antigen. In these cases depletion of target cells is undesirable and can be considered a side effect. For example, the ability of anti- CD4 antibodies to block CD4 receptors on T cells makes them effective anti-inflammatories, yet their ability to recruit FcγR receptors also directs immune attack against the target cells, resulting in T cell depletion (Reddy et al., 2000, *J Immunol* 164:1925-1933). Effector function can also be a problem for radiolabeled antibodies, referred to as radioconjugates, and antibodies conjugated to toxins, referred to as immunotoxins. These drugs can be used to destroy cancer cells, but the recruitment of immune cells via Fc interaction with FcγRs brings healthy immune cells in proximity to the deadly payload (radiation or toxin), resulting in depletion of normal lymphoid tissue along with targeted cancer cells (Hutchins et al., 1995, *Proc Natl Acad Sci USA* 92:11980-11984; White et al., 2001, *Annu Rev Med* 52:125-145). This problem can potentially be circumvented by using IgG isotypes that poorly recruit complement or effector cells, for example IgG2 and IgG4. An alternate solution is to develop Fc variants that reduce or ablate binding (Alegre et al., 1994, *Transplantation* 57:1537-1543; Hutchins et al., 1995, *Proc Natl Acad Sci USA* 92:11980-11984; Armour et al., 1999, *Eur J Immunol* 29:2613-2624; Reddy et al., 2000, *J Immunol* 164:1925-1933; Xu et al., 2000, *Cell Immunol* 200:16-26; Shields et al., 2001, *J Biol Chem* 276:6591-6604) (U.S. Pat. No.s 6,194,551; 5,885,573; PCT WO 99/58572). A critical consideration for the reduction or elimination of effector function is that other important antibody properties not be perturbed. Fc variants should be engineered that not only ablate binding to FcγRs and/or C1q, but also maintain antibody stability, solubility, and structural integrity, as well as ability to interact with other important Fc ligands such as FcRn and proteins A and G.

The present invention addresses another major shortcoming of antibodies, namely their demanding production requirements (Garber, 2001, *Nat Biotechnol* 19:184-185; Dove, 2002, *Nat Biotechnol* 20:777-779). Antibodies must be expressed in mammalian cells, and the currently marketed antibodies together with other high-demand biotherapeutics consume essentially all of the available manufacturing capacity. With hundreds of biologics in development, the majority of which are antibodies, there is an urgent need for more efficient and cheaper methods of production. The downstream effects of insufficient antibody manufacturing capacity are three-fold. First, it dramatically raises the cost of goods to the producer, a cost that is passed on to the patient. Second, it hinders industrial production of approved antibody products, limiting availability of high demand therapeutics to patients. Finally, because clinical trials require large amounts of a protein that is not yet profitable, the insufficient supply impedes progress of the growing antibody pipeline to market.

Alternative production methods have been explored in attempts at alleviating this problem. Transgenic plants and animals are being pursued as potentially cheaper and higher capacity production systems (Chadd et al., 2001, *Curr Opin Biotechnol* 12:188-194). Such expression systems, however, can generate glycosylation patterns significantly different from human glycoproteins. This may result in reduced or even lack of effector function because, as discussed above, the carbohydrate structure can significantly impact FcγR and complement binding. A potentially greater problem with non-human glycoforms may be immunogenicity; carbohydrates are a key source of antigenicity for the immune system, and the presence of nonhuman glycoforms has a significant chance of eliciting antibodies that neutralize the therapeutic, or worse cause adverse immune reactions. Thus the efficacy and safety of antibodies produced by transgenic plants and animals remains uncertain. Bacterial expression is another attractive solution to the antibody production problem.

Expression in bacteria, for example *E. coli*, provides a cost-effective and high capacity method for producing proteins. For complex proteins such as antibodies there are a number of obstacles to bacterial expression, including folding and assembly of these complex molecules, proper disulfide formation, and solubility, stability, and functionality in the absence of glycosylation because proteins expressed in bacteria are not glycosylated. Full length unglycosylated antibodies that bind antigen have been successfully expressed in *E. coli* (Simmons et al., 2002, *J Immunol Methods* 263:133-147), and thus, folding, assembly, and proper disulfide formation of bacterially expressed antibodies are possible in the absence of the eukaryotic chaperone machinery. However the ultimate utility of bacterially expressed antibodies as therapeutics remains hindered by the lack of glycosylation, which results in lack effector function and may result in poor stability and solubility. This will likely be more problematic for formulation at the high concentrations for the prolonged periods demanded by clinical use.

An aglycosylated Fc with favorable solution properties and the capacity to mediate effector functions would be significantly enabling for the alternate production methods described above. By overcoming the structural and functional shortcomings of aglycosylated Fc, antibodies can be produced in bacteria and transgenic plants and animals with reduced risk of immunogenicity, and with effector function for clinical applications in which cytotoxicity is desired such as cancer. The present invention describes the utilization of protein engineering methods to develop stable, soluble Fc variants with effector function. Currently, such Fc variants do not exist in the art.

In summary, there is a need for antibodies with enhanced therapeutic properties. Engineering of optimized or enhanced Fc variants is a promising approach to meeting this need. Yet a substantial obstacle to engineering Fc variants with the desired properties is the difficulty in predicting what amino acid modifications, out of the enormous number of possibilities, will achieve the desired goals, coupled with the inefficient production and screening methods for antibodies. Indeed one of the principle reasons for the incomplete success of the prior art is that approaches to Fc engineering have thus far involved hit-or-miss methods such as alanine scans or production of glycoforms using different expression strains. In these studies, the Fc modifications that were made were fully or partly random in hopes of obtaining variants with favorable properties. The present invention provides a variety of engineering methods, many of which are based on more sophisticated and efficient techniques, which may be used to overcome these obstacles in order to develop Fc variants that are optimized for the desired properties. The described engineering methods provide design strategies to guide Fc modification, computational screening methods to design favorable Fc variants, library generation approaches for determining promising variants for experimental investigation, and an array of experimental production and screening methods for determining the Fc variants with favorable properties.

SUMMARY OF THE INVENTION

The present invention provides Fc variants that are optimized for a number of therapeutically relevant properties. These Fc variants are generally contained within a variant protein, that preferably comprises an antibody or a Fc fusion protein.

It is an object of the present invention to provide novel Fc positions at which amino acid modifications may be made to generate optimized Fc variants. Said Fc positions include 230, 240, 244, 245, 247, 262, 263, 266, 273, 275, 299, 302, 313, 323, 325, 328, and 332, wherein the numbering of the residues in the Fc region is that of the EU index as in Kabat. The present invention describes any amino acid modification at any of said novel Fc positions in order to generate an optimized Fc variant.

It is a further object of the present invention to provide Fc variants that have been screened computationally. A computationally screened Fc variant is one that is predicted by the computational screening calculations described herein as having a significantly greater potential than random for being optimized for a desired property. In this way, computational screening serves as a prelude to or surrogate for experimental screening, and thus said computationally screened Fc variants are considered novel.

It is a further object of the present invention to provide Fc variants that have been characterized using one or more of the experimental methods described herein. In one embodiment, said Fc variants comprise at least one amino acid substitution at a position selected from the group consisting of: 230, 233, 234, 235, 239, 240, 241, 243, 244, 245, 247, 262, 263, 264, 265, 266, 267, 269, 270, 272, 273, 274, 275, 276, 278, 283, 296, 297, 298, 299, 302, 313, 318, 320, 323, 324, 325, 326, 327, 328, 329, 330, 331, 332, 333, 334, and 335, wherein the numbering of the residues in the Fc region is that of the EU index as in Kabat. In one embodiment, said Fc variants comprise at least one amino acid substitution at a position selected from the group consisting of: 221, 222, 224, 227, 228, 230, 231, 223, 233, 234, 235, 236, 237, 238, 239, 240, 241, 243, 244, 245, 246, 247, 249, 250, 258, 262, 263, 264, 265, 266, 267, 268, 269, 270, 271, 272, 273, 274, 275, 276, 278, 280, 281, 283, 285, 286, 288, 290, 291, 293, 294, 295, 296, 297, 298, 299, 300, 302, 313, 317, 318, 320, 322, 323, 324, 325, 326, 327, 328, 329, 330, 331, 332, 333, 334, 335 336 and 428, wherein the numbering of the residues in the Fc region is that of the EU index as in Kabat. In a preferred embodiment, said Fc variants comprise at least one substitution selected from the group consisting of P230A, E233D, L234D, L234E, L234N, L234Q, L234T, L234H, L234Y, L234I, L234V, L234F, L235D, L235S, L235N, L235Q, L235T, L235H, L235Y, L235I, L235V, L235F, S239D, S239E, S239N, S239Q, S239F, S239T, S239H, S239Y, V240I, V240A, V240T, V240M, F241W, F241L, F241Y, F241E, F241R, F243W, F243L F243Y, F243R, F243Q, P244H, P245A, P247V, P247G, V262I, V262A, V262T, V262E, V263I, V263A, V263T, V263M, V264L, V264I, V264W, V264T, V264R, V264F, V264M, V264Y, V264E, D265G, D265N, D265Q, D265Y, D265F, D265V, D265I, D265L, D265H, D265T, V266I, V266A, V266T, V266M, S267Q, S267L, S267T, S267H, S267D, S267N, E269H, E269Y, E269F, E269R, E269T, E269L, E269N, D270Q, D270T, D270H, E272S, E272K, E272I, E272Y, V273I, K274T, K274E, K274R, K274L, K274Y, F275W, N276S, N276E, N276R, N276L, N276Y, Y278T, Y278E, Y278K, Y278W, E283R, Y296E, Y296Q, Y296D, Y296N, Y296S, Y296T, Y296L, Y296I, Y296H, N297S, N297D, N297E, A298H, T299I, T299L, T299A, T299S, T299V, T299H, T299F, T299E, V302I, W313F, E318R, K320T, K320D, K320I, K322T, K322H, V323I, S324T, S324D, S324R, S324I, S324V, S324L, S324Y, N325Q, N325L, N325I, N325D, N325E, N325A, N325T, N325V, N325H, K326L, K326I, K326T, A327N, A327L, A327D, A327T, L328M, L328D, L328E, L328N, L328Q, L328F, L328I, L328V, L328T, L328H, L328A, P329F, A330L, A330Y, A330V, A330I, A330F, A330R, A330H, A330S, A330W, A330M, P331V, P331H, I332D, I332E, I332N, I332Q, I332T, I332H, I332Y, I332A, E333T, E333H, E333I, E333Y, K334I, K334T, K334F, T335D, T335R, and T335Y, wherein the numbering of the residues in the Fc region is that of the EU index as in Kabat. In a mostly preferred embodiment, said Fc variants are selected from the group consisting of V264L, V264I, F241W, F241L, F243W, F243L, F241L/F243L/V262I/V264I, F241W/F243W, F241W/F243W/V262A/V264A, F241L/V262I, F243L/V264I, F243L/V262I/V264W, F241Y/F243Y/V262T/V264T, F241E/F243R/V262E/V264R, F241E/F243Q/V262T/V264E, F241R/F243Q/V262T/V264R, F241E/F243Y/V262T/V264R, L328M, L328E, L328F, I332E, L328M, I332E, P244H, P245A, P247V, W313F, P244H/P245A/P247V, P247G, V264I/I332E, F241E/F243R/V262E/V264R/I332E, F241E/F243Q/V262T/V264E/I332E, F241R/F243Q/V262T/V264R/I332E, F241 E/F243Y/V262T/V264R/I1332E, S298A/I332E, S239E/I332E, S239Q/I332E, S239E, D265G, D265N, S239E/D265G, S239E/D265N, S239E/D265Q, Y296E, Y296Q, T299I, A327N, S267Q/A327S, S267L/A327S, A327L, P329F, A330L, A330Y, I332D, N297S, N297D, N297S/I332E, N297D/I332E, N297E/I332E, D265Y/N297D/I332E, D265Y/N297D/T299L/I332E, D265F/N297E/I332E, L328I/I332E, L328Q/I332E, I332N, I332Q, V264T, V264F, V240I, V263I, V266I, T299A, T299S, T299V, N325Q, N325L, N325I, S239D, S239N, S239F, S239D/I332D, S239D/I332E, S239D/I332N, S239D/I332Q, S239E/I332D, S239E/I332N, S239E/I332Q, S239N/I332D, S239N/I332E, S239N/I332N, S239N/I332Q, S239Q/I332D, S239Q/I332N, S239Q/I332Q, Y296D, Y296N, F241Y/F243Y/V262T/V264T/N297D/I332E, A330Y/I332E, V264I/A330Y/I332E, A330L/I332E, V264I/A330L/I332E, L234D, L234E, L234N, L234Q, L234T, L234H, L234Y, L234I, L234V, L234F, L235D, L235S, L235N, L235Q, L235T, L235H, L235Y, L235I, L235V, L235F, S239T, S239H, S239Y, V240A, V240T, V240M, V263A, V263T, V263M, V264M, V264Y, V266A, V266T, V266M, E269H, E269Y, E269F, E269R, Y296S, Y296T, Y296L, Y296I, A298H, T299H, A330V, A330I, A330F, A330R, A330H, N325D, N325E, N325A, N325T, N325V, N325H, L328D/I332E, L328E/I332E, L328N/I332E, L328Q/I332E, L328V/I332E, L328T/I332E, L328H/I332E, L328I/I332E, L328A, I332T, I332H, I332Y, I332A, S239E/V264I/I332E, S239Q/V264I/I332E, S239E/V264I/A330Y/I332E, S239E/V264I/S298A/A330Y/I332E, S239D/N297D/I332E, S239E/N297D/I332E, S239D/D265V/N297D/I332E, S239D/D265I/N297D/I332 E, S239D/D265L/N297D/I332E, S239D/D265F/N297D/I332 E, S239D/D265Y/N297D/I332E, S239D/D265H/N297D/I332E, S239D/D265T/N297D/I332E, V264E/N297D/I332E, Y296D/N297D/I332E, Y296E/N297D/I332E, Y296N/N297D/I332E, Y296Q/N297D/I332E, Y296H/N297D/I332E, Y296T/N297D/I332E, N297D/T299V/I332E, N297D/T299I/I332E, N297D/T299L/I332E, N297D/T299F/I332E, N297D/T299H/I332E, N297D/T299E/I332E, N297D/A330Y/I332E, N297D/S298A/A330Y/I332E, S239D/A330Y/I332E, S239N/A330Y/I332E, S239D/A330L/I332E, S239N/A330L/I332E, V264I/S298A/I332E, S239D/S298A/I332E, S239N/S298A/I332E, S239D/V264I/I332E, S239D/V264I/A330L/I332E, V264I/S298A/I332E, S239D/V264I/A330L/I332E, L328N, L328H, S239D/I332E/A330I, N297D/I332E/S239D/A330L, P230A, E233D, P230A/E233D, P230A/E233D/I332E, S267T, S267H, S267D, S267N, E269T, E269L, E269N, D270Q, D270T, D270H, E272S, E272K, E272I, E272Y, V273I, K274T, K274E, K274R, K274L, K274Y, F275W, N276S, N276E, N276R, N276L, N276Y, Y278T, Y278E, Y278K, Y278W, E283R, V302I, E318R, K320T, K320D, K320I, K322T, K322H, V323I, S324T, S324D, S324R, S324I, S324V, S324L, S324Y, K326L, K326I, K326T, A327D, A327T, A330S, A330W, A330M, P331V, P331H, E333T, E333H, E333I, E333Y, K334I, K334T, K334F, T335D, T335R, T335Y, L234I/L235D, V240I/ V266I, S239D/A330Y/I332E/L234I, S239D/A330Y/I332E/ L235D, S239D/A330Y/I332E/V240I, S239D/A330Y/ I332E/V264T, S239D/A330Y/I332E/V266I, S239D/ A330Y/I332E/K326E, S239D/A330Y/I332E/K326T, S239D/N297D/I332E/A330Y, S239D/N297D/I332E/ A330Y/F241S/F243H/V262T/V264T, S239D/N297D/ I332E/L235D, and S239D/N297D/I332E/K326E, wherein the numbering of the residues in the Fc region is that of the EU index as in Kabat.

It is a further object of the present invention to provide Fc variants that are selected from the group consisting of D221K, D221Y, K222E, K222Y, T223E, T223K, H224E, H224Y, T225E, T225, T225K, T225W, P227E, P227K, P227Y, P227G, P228E, P228K, P228Y, P228G, P230E, P230Y, P230G, A231E, A231K, A231Y, A231P, A231G, P232E, P232K, P232Y, P232G, E233N, E233Q, E233K, E233R, E233S, E233T, E233H, E233A, E233V, E233L, E233I, E233F, E233M, E233Y, E233W, E233G, L234K, L234R, L234S, L234A, L234M, L234W, L234P, L234G, L235E, L235K, L235R, L235A, L235M, L235W, L235P, L235G, G236D, G236E, G236N, G236Q, G236K, G236R, G236S, G236T, G236H, G236A, G236V, G236L, G236I, G236F, G236M, G236Y, G236W, G236P, G237D, G237E, G237N, G237Q, G237K, G237R, G237S, G237T, G237H, G237V, G237L, G237I, G237F, G237M, G237Y, G237W, G237P, P238D, P238E, P238N, P238Q, P238K, P238R, P238S, P238T, P238H, P238V, P238L, P238I, P238F, P238M, P238Y, P238W, P238G, S239Q, S239K, S239R, S239V, S239L, S239I, S239M, S239W, S239P, S239G, F241D, F241E, F241Y, F243E, K246D, K246E, K246H, K246Y, D249Q, D249H, D249Y, R255E, R255Y, E258S, E258H, E258Y, T260D, T260E, T260H, T260Y, V262E, V262F, V264D, V264E, V264N, V264Q, V264K, V264R, V264S, V264H, V264W, V264P, V264G, D265Q, D265K, D265R, D265S, D265T, D265H, D265V, D265L, D265I, D265F, D265M, D265Y, D265W, D265P, S267E, S267Q, S267K, S267R, S267V, S267L, S267I, S267F, S267M, S267Y, S267W, S267P, H268D, H268E, H268Q, H268K, H268R, H268T, H268V, H268L, H268I, H268F, H268N, H268W, H268P, H268G, E269K, E269S, E269V, E269I, E269M, E269W, E269P, E269G, D270R, D270S, D270L, D270I, D270F, D270M, D270Y, D270W, D270P, D270G, P271D, P271E, P271N, P271Q, P271 K, P271R, P271S, P271T, P271H, P271A, P271V, P271L, P271I, P271F, P271M, P271Y, P271W, P271G, E272D, E272R, E272T, E272H, E272V, E272L, E272F, E272M, E272W, E272P, E272G, K274D, K274N, K274S, K274H, K274V, K274I, K274F, K274M, K274W, K274P, K274G, F275L, N276D, N276T, N276H, N276V, N276I, N276F, N276M, N276W, N276P, N276G, Y278D, Y278N, Y278Q, Y278R, Y278S, Y278H, Y278V, Y278L, Y278I, Y278M, Y278P, Y278G, D280K, D280L, D280W, D280P, D280G, G281D, G281K, G281Y, G281P, V282E, V282K, V282Y, V282P, V282G, E283K, E283H, E283L, E283Y, E283P, E283G, V284E, V284N, V284T, V284L, V284Y, H285D, H285E, H285Q, H285K, H285Y, H285W, N286E, N286Y, N286P, N286G, K288D, K288E, K288Y, K290D, K290N, K290H, K290L, K290W, P291D, P291E, P291Q, P291T, P291H, P291I, P291G, R292D, R292E, R292T, R292Y, E293N, E293R, E293S, E293T, E293H, E293V, E293L, E293I, E293F, E293M, E293Y, E293W, E293P, E293G, E294K, E294R, E294S, E294T, E294H, E294V, E294L, E294I, E294F, E294M, E294Y, E294W, E294P, E294G, Q295D, Q295E, Q295N, Q295R, Q295S, Q295T, Q295H, Q295V, Q295I, Q295F, Q295M, Q295Y, Q295W, Q295P, Q295G, Y296K, Y296R, Y296A, Y296V, Y296M, Y296G, N297D, N297K, N297R, N297T, N297H, N297V, N297L, N297I, N297F, N297M, N297Y, N297W, N297P, N297G, S298D, S298E, S298Q, S298K, S298R, S298I, S298F, S298M, S298Y, S298W, T299D, T299E, T299N, T299Q, T299K, T299R, T299L, T299F, T299M, T299Y, T299W, T299P, T299G, Y300D, Y300E, Y300N, Y300Q, Y300K, Y300R, Y300S, Y300T, Y300H, Y300A, Y300V, Y300M, Y300W, Y300P, Y300G, R301D, R301E, R301H, R301Y, V303D, V303E, V303Y, S304D, S304N, S304T, S304H, S304L, V305E, V305T, V305Y, K317E, K317Q, E318Q, E318H, E318L, E318Y, K320N, K320S, K320H, K320V, K320L, K320F, K320Y, K320W, K320P, K320G, K322D, K322S, K322V, K322I, K322F, K322Y, K322W, K322P, K322G, S324H, S324F, S324M, S324W, S324P, S324G, N325K, N325R, N325S, N325F, N325M, N325Y, N325W, N325P, N325G, K326P, A327E, A327K, A327R, A327H, A327V, A327I, A327F, A327M, A327Y, A327W, A327P, L328D, L328Q, L328K, L328R, L328S, L328T, L328V, L328I, L328Y, L328W, L328P, L328G, P329D, P329E, P329N, P329Q, P329K, P329R, P329S, P329T, P329H, P329V, P329L, P329I, P329M, P329Y, P329W, P329G, A330E, A330N, A330T, A330P, A330G, P331D, P331Q, P331H, P331T, P331L, P331I, P331F, P331M, P331Y, P331W, I332K, I332R, I332S, I332V, I332L, I332F, I332M, I332W, I332P, I332G, E333L, E333F, E333M, E333P, K334P, T335N, T335S, T335H, T335V, T335L, T335I, T335F, T335M, T335W, T335P, T335G, I336E, I336K, I336Y, S337E, S337N, and S337H, wherein the numbering of the residues in the Fc region is that of the EU index as in Kabat.

It is a further object of the present invention to provide an Fc variant that binds with greater affinity to one or more FcγRs. In one embodiment, said Fc variants have affinity for an FcγR that is more than 1-fold greater than that of the parent Fc polypeptide. In an alternate embodiment, said Fc variants have affinity for an FcγR that is more than 5-fold greater than that of the parent Fc polypeptide. In a preferred embodiment, said Fc variants have affinity for an FcγR that is between 5-fold and 300-fold greater than that of the parent Fc polypeptide. In one embodiment, said Fc variants comprise at least one amino acid substitution at a position selected from the group consisting of: 230, 233, 234, 235, 239, 240, 243, 264, 266, 272, 274, 275, 276, 278, 302, 318, 324, 325, 326, 328, 330, 332, and 335, wherein the numbering of the residues in the Fc region is that of the EU index as in Kabat. In a preferred embodiment, said Fc variants comprise at least one amino acid substitution selected from the group consisting of: P230A, E233D, L234E, L234Y, L234I, L235D, L235S, L235Y, L235I, S239D, S239E, S239N, S239Q, S239T, V240I, V240M, F243L, V264I, V264T, V264Y, V266I, E272Y, K274T, K274E, K274R, K274L, K274Y, F275W, N276L, Y278T, V302I, E318R, S324D, S324I, S324V, N325T, K326I, K326T, L328M, L328I, L328Q, L328D, L328V, L328T, A330Y, A330L, A330I, I332D, I332E, I332N, I332Q, T335D, T335R, and T335Y, wherein the numbering of the residues in the Fc region is that of the EU index as in Kabat. In a mostly preferred embodiment, said Fc variants are selected from the group consisting of V264I, F243L/V264I, L328M, I332E, L328M/I332E, V264I/I332E, S298A/I332E, S239E/I332E, S239Q/I332E, S239E, A330Y, I332D, L328I/ I332E, L328Q/I332E, V264T, V240I, V266I, S239D, S239D/ I332D, S239D/I332E, S239D/I332N, S239D/I332Q, S239E/ I332D, S239E/I332E, S239E/I332N, S239E/I332Q, S239N/ I332D, S239N/I332E, S239Q/I332D, A330Y/I332E, V264I/A330Y/I332E, A330L/I332E, V264I/A330L/I332E, L234E, L234Y, L234I, L235D, L235S, L235Y, L235I, S239T, V240M, V264Y, A330I, N325T, L328D/I332E, L328V/I332E, L328T/I332E, L328I/I332E, S239E/V264I/I332E, S239Q/V264I/I332E, S239E/V264I/A330Y/I332E, S239D/A330Y/I332E, S239N/A330Y/I332E, S239D/A330L/I332E, S239N/A330L/I332E, V264I/S298A/I332E, S239D/S298A/I332E, S239N/S298A/I332E, S239D/V264I/I332E, S239D/V264I/S298A/I332E, S239D/V264I/A330L/I332E, S239D/I332E/A330I, P230A, P230A/E233D/I332E, E272Y, K274T, K274E, K274R, K274L, K274Y, F275W, N276L, Y278T, V302I, E318R, S324D, S324I, S324V, K326I, K326T, T335D, T335R, T335Y, V240I/V266I, S239D/A330Y/I332E/L234I, S239D/A330Y/I332E/L235D, S239D/A330Y/I332E/V240I, S239D/A330Y/I332E/V264T, S239D/A330Y/I332E/K326E, and S239D/A330Y/I332E/K326T, wherein the numbering of the residues in the Fc region is that of the EU index as in Kabat.

It is a further object of the present invention to provide Fc variant that have a FcγRIIa-fold:FcγRIIb-fold ratio greater than 1:1. In one embodiment, said Fc variants have a FcγRIIIa-fold:FcγRIIb-fold ratio greater than 11:1. In a preferred embodiment, said Fc variants have a FcγRIIIa-fold:FcγRIIb-fold ratio between 11:1 and 86:1. In one embodiment, said Fc variants comprise at least one amino acid substitution at a position selected from the group consisting of: 234, 235, 239, 240, 264, 296, 330, and 1332, wherein the numbering of the residues in the Fc region is that of the EU index as in Kabat. In a preferred embodiment, said Fc variants comprise at least one amino acid substitution selected from the group consisting of: L234Y, L234I, L235I, S239D, S239E, S239N, S239Q, V240A, V240M, V264I, V264Y, Y296Q, A330L, A330Y, A330I, I332D, and I332E, wherein the numbering of the residues in the Fc region is that of the EU index as in Kabat. In a mostly preferred embodiment, said Fc variants are selected from the group consisting of: I332E, V264I/I332E, S239E/I332E, S239Q/I332E, Y296Q, A330L, A330Y, I332D, S239D, S239D/I332E, A330Y/I332E, V264I/A330Y/I332E, A330L/I332E, V264I/A330L/I332E, L234Y, L234I, L235I, V240A, V240M, V264Y, A330I, S239D/A330L/I332E, S239D/S298A/I332E, S239N/S298A/I332E, S239D/V264I/I332E, S239D/V264I/S298A/I332E, and S239D/V264I/A330L/I332E, wherein the numbering of the residues in the Fc region is that of the EU index as in Kabat.

It is a further object of the present invention to provide Fc variants that mediate effector function more effectively in the presence of effector cells. In one embodiment, said Fc variants mediate ADCC that is greater than that mediated by the parent Fc polypeptide. In a preferred embodiment, said Fc variants mediate ADCC that is more than 5-fold greater than that mediated by the parent Fc polypeptide. In a mostly preferred embodiment, said Fc variants mediate ADCC that is between 5-fold and 1000-fold greater than that mediated by the parent Fc polypeptide. In one embodiment, said Fc variants comprise at least one amino acid substitution at a position selected from the group consisting of: 230, 233, 234, 235, 239, 240, 243, 264, 266, 272, 274, 275, 276, 278, 302, 318, 324, 325, 326, 328, 330, 332, and 335, wherein the numbering of the residues in the Fc region is that of the EU index as in Kabat. In a preferred embodiment, said Fc variants comprise at least one amino acid substitutions selected from the group consisting of: P230A, E233D, L234E, L234Y, L234I, L235D, L235S, L235Y, L235I, S239D, S239E, S239N, S239Q, S239T, V240I, V240M, F243L, V264I, V264T, V264Y, V266I, E272Y, K274T, K274E, K274R, K274L, K274Y, F275W, N276L, Y278T, V302I, E318R, S324D, S324I, S324V, N325T, K326I, K326T, L328M, L328I, L328Q, L328D, L328V, L328T, A330Y, A330L, A330I, I332D, I332E, I332N, I332Q, T335D, T335R, and T335Y, wherein the numbering of the residues in the Fc region is that of the EU index as in Kabat. In a mostly preferred embodiment, said Fc variants are selected from the group consisting of: V264I, F243L/V264I, L328M, I332E, L328M/I332E, V264I/I332E, S298A/I332E, S239E/I332E, S239Q/I332E, S239E, A330Y, I332D, L328I/I332E, L328Q/I332E, V264T, V240I, V266I, S239D, S239D/I332D, S239D/I332E, S239D/I332N, S239D/I332Q, S239E/I332D, S239E/I332N, S239E/I332Q, S239N/I332D, S239N/I332E, S239Q/I332D, A330Y/I332E, V264I/A330Y/I332E, A330L/I332E, V264I/A330L/I332E, L234E, L234Y, L234I, L235D, L235S, L235Y, L235I, S239T, V240M, V264Y, A330I, N325T, L328D/I332E, L328V/I332E, L328T/I332E, L328I/I332E, S239E/V264I/I332E, S239Q/V264I/I332E, S239E/V264I/A330Y/I332E, S239D/A330Y/I332E, S239N/A330Y/I332E, S239D/A330L/I332E, S239N/A330L/I332E, V264I/S298A/I332E, S239D/S298A/I332E, S239N/S298A/I332E, S239D/V264I/I332E, S239D/V264I/S298A11332E, S239D/V264I/A330L/I332E, S239D/I332E/A330I, P230A, P230A/E233D/I332E, E272Y, K274T, K274E, K274R, K274L, K274Y, F275W, N276L, Y278T, V302I, E318R, S324D, S324I, S324V, K326I, K326T, T335D, T335R, T335Y, V2401N266I, S239D/A330Y/I332E/L234I, S239D/A330Y/I332E/L235D, S239D/A330Y/I332E/V2401, S239D/A330Y/I332E/V264T, S239D/A330Y/I332E/K326E, and S239D/A330Y/I332E/K326T, wherein the numbering of the residues in the Fc region is that of the EU index as in Kabat.

It is a further object of the present invention to provide Fc variants that bind with weaker affinity to one or more FcγRs. In one embodiment, said Fc variants comprise at least one amino acid substitution at a position selected from the group consisting of: 230, 233, 234, 235, 239, 240, 241, 243, 244, 245, 247, 262, 263, 264, 265, 266, 267, 269, 270, 273, 276, 278, 283, 296, 297, 298, 299, 313, 323, 324, 325, 327, 328, 329, 330, 332, and 333, wherein the numbering of the residues in the Fc region is that of the EU index as in Kabat. In a preferred embodiment, said Fc variants comprise an amino acid substitution at a position selected from the group consisting of: P230A, E233D, L234D, L234N, L234Q, L234T, L234H, L234V, L234F, L234I, L235N, L235Q, L235T, L235H, L235V, L235F, L235D, S239E, S239N, S239Q, S239F, S239H, S239Y, V240A, V240T, F241W, F241L, F241Y, F241 E, F241R, F243W, F243L F243Y, F243R, F243Q, P244H, P245A, P247V, P247G, V2621, V262A, V262T, V262E, V263I, V263A, V263T, V263M, V264L, V264I, V264W, V264T, V264R, V264F, V264M, V264E, D265G, D265N, D265Q, D265Y, D265F, D265V, D265I, D265L, D265H, D265T, V266A, V266T, V266M, S267Q, S267L, E269H, E269Y, E269F, E269R, E269T, E269L, E269N, D270Q, D270T, D270H, V273I, N276S, N276E, N276R, N276Y, Y278E, Y278W, E283R, Y296E, Y296Q, Y296D, Y296N, Y296S, Y296T, Y296L, Y296I, Y296H, N297S, N297D, N297E, A298H, T299I, T299L, T299A, T299S, T299V, T299H, T299F, T299E, W313F, V323I, S324R, S324L, S324Y, N325Q, N325L, N325I, N325D, N325E, N325A, N325V, N325H, A327N, A327L, L328M, 328E, L328N, L328Q, A327D, A327T, L328F, L328H, L328A, L328N, L328H, P329F, A330L, A330V, A330F, A330R, A330H, I332N, I332Q, I332T, I332H, I332Y, I332A, E333T, and E333H, wherein the numbering of the residues in the Fc region is that of the EU index as in Kabat. In a mostly preferred embodiment, said Fc variants are selected from the group consisting of: V264L, F241W, F241L, F243W, F243L, F241L/F243L/V2621N264I, F241W/F243W, F241W/F243W/V262A/V264A, F241L/V262I, F243L/V262I/

V264T, F241Y/F243Y/V262T/V264T, F241E/F243R/ V262E/V264R, F241 E/F243Q/V262T/V264E, F241R/ F243Q/V262T/V264R, F241 E/F243Y/V262T/V264R, L328M, L328E, L328F, P244H, P245A, P247V, W313F, P244H/P245A/P247V, P247G, F241E/F243R/V262E/ V264R/I332E, F241E/F243Y/V262T/V264R/I332E, D265G, D265N, S239E/D265G, S239E/D265N, S239E/ D265Q, Y296E, Y296Q, T299I, A327N, S267Q/A327S, S267L/A327S, A327L, P329F, A330L, N297S, N297D, N297S/I332E, I332N, I332Q, V264F, V263I, T299A, T299S, T299V, N325Q, N325L, N325I, S239N, S239F, S239N/I332N, S239N/I332Q, S239Q/I332N, S239Q/I332Q, Y296D, Y296N, L234D, L234N, L234Q, L234T, L234H, L234V, L234F, L235N, L235Q, L235T, L235H, L235V, L235F, S239H, S239Y, V240A, V263T, V263M, V264M, V266A, V266T, V266M, E269H, E269Y, E269F, E269R, Y296S, Y296T, Y296L, Y296I, A298H, T299H, A330V, A330F, A330R, A330H, N325D, N325E, N325A, N325V, N325H, L328E/I332E, L328N/I332E, L328Q/I332E, L328H/I332E, L328A, I332T, I332H, I332Y, I332A, L328N, L328H, E233D, P230A/E233D, E269T, E269L, E269N, D270Q, D270T, D270H, V273I, N276S, N276E, N276R, N276Y, Y278E, Y278W, E283R, V323I, S324R, S324L, S324Y, A327D, A327T, E333T, E333H, and L234I/L235D, wherein the numbering of the residues in the Fc region is that of the EU index as in Kabat.

It is a further object of the present invention to provide Fc variants that mediate ADCC in the presence of effector cells less effectively. In one embodiment, said Fc variants comprise at least one amino acid substitution at a position selected from the group consisting of: 230, 233, 234, 235, 239, 240, 241, 243, 244, 245, 247, 262, 263, 264, 265, 266, 267, 269, 270, 273, 276, 278, 283, 296, 297, 298, 299, 313, 323, 324, 325, 327, 328, 329, 330, 332, and 333, wherein the numbering of the residues in the Fc region is that of the EU index as in Kabat. In a preferred embodiment, said Fc variants comprise at least one amino acid substitution at a position selected from the group consisting of: P230A, E233D, L234D, L234N, L234Q, L234T, L234H, L234V, L234F, L234I, L235N, L235Q, L235T, L235H, L235V, L235F, L235D, S239E, S239N, S239Q, S239F, S239H, S239Y, V240A, V240T, F241W, F241L, F241Y, F241E, F241R, F243W, F243L F243Y, F243R, F243Q, P244H, P245A, P247V, P247G, V262I, V262A, V262T, V262E, V263I, V263A, V263T, V263M, V264L, V264I, V264W, V264T, V264R, V264F, V264M, V264E, D265G, D265N, D265Q, D265Y, D265F, D265V, D265I, D265L, D265H, D265T, V266A, V266T, V266M, S267Q, S267L, E269H, E269Y, E269F, E269R, E269T, E269L, E269N, D270Q, D270T, D270H, V273I, N276S, N276E, N276R, N276Y, Y278E, Y278W, E283R, Y296E, Y296Q, Y296D, Y296N, Y296S, Y296T, Y296L, Y296I, Y296H, N297S, N297D, N297E, A298H, T299I, T299L, T299A, T299S, T299V, T299H, T299F, T299E, W313F, V323I, S324R, S324L, S324Y, N325Q, N325L, N325I, N325D, N325E, N325A, N325V, N325H, A327N, A327L, L328M, I328E, L328N, L328Q, A327D, A327T, L328F, L328H, L328A, L328N, L328H, P329F, A330L, A330V, A330F, A330R, A330H, I332N, I332Q, I332T, I332H, I332Y, I332A, E333T, and E333H, wherein the numbering of the residues in the Fc region is that of the EU index as in Kabat. In a mostly preferred embodiment, said Fc variants are selected from the group consisting of: V264L, F241W, F241L, F243W, F243L, F241L/F243L/ V262I/N264I, F241W/F243W, F241 W/F243W/V262A/ V264A, F241 L/V262I, F243L/V262I/N264W, F241 Y/F243Y/V262T/V264T, F241 E/F243R/V262E/V264R, F241 E/F243Q/V262T/V264E, F241R/F243Q/V262T/ V264R, F241E/F243Y/V262T/V264R, L328M, L328E, L328F, P244H, P245A, P247V, W313F, P244H/P245A/ P247V, P247G, F241E/F243R/V262E/V264R/I332E, F241 E/F243Y/V262T/V264R/I332E, D265G, D265N, S239E/ D265G, S239E/D265N, S239E/D265Q, Y296E, Y296Q, T299I, A327N, S267Q/A327S, S267L/A327S, A327L, P329F, A330L, N297S, N297D, N297S/I332E, I332N, I332Q, V264F, V263I, T299A, T299S, T299V, N325Q, N325L, N325I, S239N, S239F, S239N/I332N, S239N/ I332Q, S239Q/I332N, S239Q/I332Q, Y296D, Y296N, L234D, L234N, L234Q, L234T, L234H, L234V, L234F, L235N, L235Q, L235T, L235H, L235V, L235F, S239H, S239Y, V240A, V263T, V263M, V264M, V266A, V266T, V266M, E269H, E269Y, E269F, E269R, Y296S, Y296T, Y296L, Y296I, A298H, T299H, A330V, A330F, A330R, A330H, N325D, N325E, N325A, N325V, N325H, L328E/ I332E, L328N/I332E, L328Q/I332E, L328H/I332E, L328A, I332T, I332H, I332Y, I332A, L328N, L328H, E233D, P230A/E233D, E269T, E269L, E269N, D270Q, D270T, D270H, V273I, N276S, N276E, N276R, N276Y, Y278E, Y278W, E283R, V323I, S324R, S324L, S324Y, A327D, A327T, E333T, E333H, and L234I/L235D, wherein the numbering of the residues in the Fc region is that of the EU index as in Kabat.

It is a further object of the present invention to provide Fc variants that have improved function and/or solution properties as compared to the aglycosylated form of the parent Fc polypeptide. Improved functionality herein includes but is not limited to binding affinity to an Fc ligand. Improved solution properties herein includes but is not limited to stability and solubility. In one embodiment, said aglycosylated Fc variants bind to an FcγR with an affinity that is comparable to or better than the glycosylated parent Fc polypeptide. In an alternate embodiment, said Fc variants bind to an FcγR with an affinity that is within 0.4-fold of the glycosylated form of the parent Fc polypeptide. In one embodiment, said Fc variants comprise at least one amino acid substitution at a position selected from the group consisting of: 239, 241, 243, 262, 264, 265, 296, 297, 330, and 332, wherein the numbering of the residues in the Fc region is that of the EU index as in Kabat. In a preferred embodiment, said Fc variants comprise an amino acid substitution selected from the group consisting of: S239D, S239E, F241Y, F243Y, V262T, V264T, V264E, D265Y, D265H, D265V, D265I, Y296N, N297D, A330Y, and 1332E, wherein the numbering of the residues in the Fc region is that of the EU index as in Kabat. In a mostly preferred embodiment, said Fc variants are selected from the group consisting of: N297D/I332E, F241Y/F243Y/V262T/ V264T/N297D/I332E, S239D/N297D/I332E, S239E/ N297D/I332E, S239D/D265Y/N297D/I332E, S239D/ D265H/N297D/I332E, V264E/N297D/I332E, Y296N/ N297D/I332E, N297D/A330Y/I332E, S239D/D265V/ N297D/I332E, S239D/D265I/N297D/I332E, and N297D/ S298A/A330Y/I332E, wherein the numbering of the residues in the Fc region is that of the EU index as in Kabat.

The present invention also provides methods for engineering optimized Fc variants. It is an object of the present invention to provide design strategies that may be used to guide Fc optimization. It is a further object of the present invention to provide computational screening methods that may be used to design Fc variants. It is a further object of the present invention to provide methods for generating libraries for experimental testing. It is a further object of the present invention to provide experimental production and screening methods for obtaining optimized Fc variants.

The present invention provides isolated nucleic acids encoding the Fc variants described herein. The present invention provides vectors comprising said nucleic acids, optionally, operably linked to control sequences. The present invention provides host cells containing the vectors, and methods for producing and optionally recovering the Fc variants.

The present invention provides novel antibodies and Fc fusions that comprise the Fc variants disclosed herein. Said novel antibodies and Fc fusions may find use in a therapeutic product.

The present invention provides compositions comprising antibodies and Fc fusions that comprise the Fc variants described herein, and a physiologically or pharmaceutically acceptable carrier or diluent.

The present invention contemplates therapeutic and diagnostic uses for antibodies and Fc fusions that comprise the Fc variants disclosed herein.

BRIEF DESCRIPTION OF THE DRAWINGS

FIG. 1. Antibody structure and function. Shown is a model of a full length human IgG1 antibody, modeled using a humanized Fab structure from pdb accession code 1 CE1 (James et al., 1999, *J Mol Biol* 289:293-301) and a human IgG1 Fc structure from pdb accession code 1 D/V2 (DeLano et al., 2000, *Science* 287:1279-1283). The flexible hinge that links the Fab and Fc regions is not shown. IgG1 is a homodimer of heterodimers, made up of two light chains and two heavy chains. The Ig domains that comprise the antibody are labeled, and include $V_L$ and $C_L$ for the light chain, and $V_H$, Cgamma1 (Cγ1), Cgamma2 (Cγ2), and Cgamma3 (Cγ3) for the heavy chain. The Fc region is labeled. Binding sites for relevant proteins are labeled, including the antigen binding site in the variable region, and the binding sites for FcγRs, FcRn, C1q, and proteins A and G in the Fc region.

FIG. 2. The Fc/FcγRIIIb complex structure 1IIS. Fc is shown as a gray ribbon diagram, and FcγRIIIb is shown as a black ribbon. The N297 carbohydrate is shown as black sticks.

FIG. 3. The amino acid sequence of the heavy chain of the antibody alemtuzumab (Campath®, a registered trademark of Ilex Pharmaceuticals LP) (SEQ ID NO:1), illustrating positions numbered sequentially (2 lines above the amino acid sequence) and positions numbered according to the EU index as in Kabat (2 lines below the amino acid sequence. The approximate beginnings of Ig domains VH1, Cγ1, the hinge, Cγ2, and Cγ3 are also labeled above the sequential numbering. Polymorphisms have been observed at a number of Fc positions, including but not limited to Kabat 270, 272, 312, 315, 356, and 358, and thus slight differences between the presented sequence and sequences in the prior art may exist.

FIG. 4. Experimental library residues mapped onto the Fc/FcγRIIIb complex structure 1IIS. Fc is shown as a gray ribbon diagram, and FcγRIIIb is shown as a black ribbon. Experimental library residues are shown in black, the N297 carbohydrate is shown in grey.

FIG. 5. The human IgG1 Fc sequence (SEQ ID NO:2) showing positions relevant to the design of the Fc variant experimental library. The sequence includes the hinge region, domain Cγ2, and domain Cγ3. Residue numbers are according to the EU index as in Kabat. Positions relevant to the experimental library are underlined. Because of observed polymorphic mutations at a number of Fc positions, slight differences between the presented sequence and sequences in the literature may exist.

FIG. 6. Expression of Fc variant and wild type (WT) proteins of alemtuzumab in 293T cells. Plasmids containing alemtuzumab heavy chain genes (WT or variants) were co-transfected with plasmid containing the alemtuzumab light chain gene. Media were harvested 5 days after transfection. For each transfected sample, 10 ul medium was loaded on a SDS-PAGE gel for Western analysis. The probe for Western was peroxidase-conjugated goat-anti human IgG (Jackson Immuno-Research, catalog # 109-035-088). WT: wild type alemtuzumab; 1-10: alemtuzumab variants. H and L indicate antibody heavy chain and light chain, respectively.

FIG. 7. Purification of alemtuzumab using protein A chromatography. WT alemtuzumab proteins was expressed in 293T cells and the media was harvested 5 days after transfection. The media were diluted 1:1 with PBS and purified with protein A (Pierce, Catalog # 20334). O: original sample before purification; FT: flow through; E: elution; C: concentrated final sample. The left picture shows a Simple Blue-stained SDS-PAGE gel, and the right shows a western blot labeled using peroxidase-conjugated goat-anti human IgG.

FIG. 8. Production of deglycosylated antibodies. Wild type and variants of alemtuzumab were expressed in 293T cells and purified with protein A chromatography. Antibodies were incubated with peptide-N-glycosidase (PNGase F) at 37° C. for 24 h. For each antibody, a mock treated sample (−PNGase F) was done in parallel. WT: wild-type alemtuzumab; #15, #16, #17, #18, #22: alemtuzumab variants F241E/F243R/V262E/V264R, F241E/F243Q/V262T/V264E, F241R/F243Q/V262T/V264R, F241E/F243Y/V262T/V264R, and I332E respectively. The faster migration of the PNGase F treated versus the mock treated samples represents the deglycosylated heavy chains.

FIG. 9. Alemtuzumab expressed from 293T cells binds its antigen. The antigenic CD52 peptide, fused to GST, was expressed in *E. coli* BL21 (DE3) under IPTG induction. Both uninduced and induced samples were run on a SDS-PAGE gel, and transferred to PVDF membrane. For western analysis, either alemtuzumab from Sotec (α-CD52, Sotec) (final concentration 2.5 ng/ul) or media of transfected 293T cells (Campath, Xencor) (final alemtuzumab concentration approximately 0.1-0.2 ng/ul) were used as primary antibody, and peroxidase-conjugated goat-anti human IgG was used as secondary antibody. M: pre-stained marker; U: un-induced sample for GST-CD52; I: induced sample for GST-CD52.

FIG. 10. Expression and purification of extracellular region of human V158 FcγRIIIa. Tagged FcγRIIIa was transfected in 293T cells, and media containing secreted FcγRIIIa were harvested 3 days later and purified using affinity chromatography. 1: media; 2: flow through; 3: wash; 4-8: serial elutions. Both simple blue-stained SDS-PAGE gel and western result are shown. For the western blot, membrane was probed with anti-GST antibody.

FIG. 11. Binding to human V158 FcγRIIIa by select alemtuzumab Fc variants from the experimental library as determined by the AlphaScreen™ assay, described in Example 2. In the presence of competitor antibody (Fc variant or WT alemtuzumab) a characteristic inhibition curve is observed as a decrease in luminescence signal. Phosphate buffer saline (PBS) alone was used as the negative control. The binding data were normalized to the maximum and minimum luminescence signal for each particular curve, provided by the baselines at low and high antibody concentrations respectively. The curves represent the fits of the data to a one site competition model using nonlinear regression. These fits provide IC50s for each antibody, illustrated for WT and S239D by the dotted lines.

FIG. 12. AlphaScreen™ assay showing binding of select alemtuzumab Fc variants to human FcγRIIb. The binding data were normalized to the upper and lower baselines for each particular antibody, and the curves represent the fits of the data to a one site competition model. PBS was used as a negative control.

FIGS. 13a and 13b. AlphaScreen™ assay showing binding of select alemtuzumab (FIG. 13a) and trastuzumab (FIG. 13b) Fc variants to human Val158 FcγRIIIa. The binding data were normalized to the upper and lower baselines for each particular antibody, and the curves represent the fits of the data to a one site competition model. PBS was used as a negative control.

FIGS. 14a and 14b. AlphaScreen™ assay measuring binding to human V158 FcγRIIIa by select Fc variants in the context of trastuzumab. The binding data were normalized to the upper and lower baselines for each particular antibody, and the curves represent the fits of the data to a one site competition model. PBS was used as a negative control.

FIGS. 15a and 15b. AlphaScreen™ assay measuring binding to human V158 FcγRIIIa by select Fc variants in the context of rituximab (FIG. 15a) and cetuximab (FIG. 15b). The binding data were normalized to the upper and lower baselines for each particular antibody, and the curves represent the fits of the data to a one site competition model. PBS was used as a negative control.

FIGS. 16a-16b. AlphaScreen™ assay comparing binding of select alemtuzumab Fc variants to human V158 FcγRIIIa (FIG. 16a) and human FcγRIIb (FIG. 16b). The binding data were normalized to the upper and lower baselines for each particular antibody, and the curves represent the fits of the data to a one site competition model. PBS was used as a negative control.

FIG. 17. AlphaScreen™ assay measuring binding to human V158 FcγRIIIa by select Fc variants in the context of trastuzumab. The binding data were normalized to the upper and lower baselines for each particular antibody, and the curves represent the fits of the data to a one site competition model. PBS was used as a negative control.

FIG. 18. AlphaScreen™ assay showing binding of select alemtuzumab Fc variants to human R131 FcγRIIa. The binding data were normalized to the upper and lower baselines for each particular antibody, and the curves represent the fits of the data to a one site competition model.

FIGS. 19a and 19b. AlphaScreen™ assay showing binding of select alemtuzumab Fc variants to human V158 FcγRIIIa. The binding data were normalized to the upper and lower baselines for each particular antibody, and the curves represent the fits of the data to a one site competition model. PBS was used as a negative control.

FIG. 20. AlphaScreen™ assay showing binding of aglycosylated alemtuzumab Fc variants to human V158 FcγRIIa. The binding data were normalized to the upper and lower baselines for each particular antibody, and the curves represent the fits of the data to a one site competition model. PBS was used as a negative control.

FIG. 21. AlphaScreen™ assay comparing human V158 FcγRIIa binding by select alemtuzumab Fc variants in glycosylated (solid symbols, solid lines) and deglycosylated (open symbols, dotted lines). The binding data were normalized to the upper and lower baselines for each particular antibody, and the curves represent the fits of the data to a one site competition model.

FIGS. 22a-22b. AlphaScreen™ assay showing binding of select alemtuzumab Fc variants to the V158 (FIG. 22a) and F158 (FIG. 22b) allotypes of human FcγRIIa. The binding data were normalized to the upper and lower baselines for each particular antibody, and the curves represent the fits of the data to a one site competition model. PBS was used as a negative control.

FIGS. 23a-23d. FIGS. 23a and 23b show the correlation between SPR Kd's and AlphaScreen™ IC50's from binding of select alemtuzumab Fc variants to V158 FcγRIIIa (FIG. 23a) and F158 FcγRIIIa (FIG. 23b). FIGS. 23c and 23d show the correlation between SPR and AlphaScreen™ fold-improvements over WT for binding of select alemtuzumab Fc variants to V158 FcγRIIIa (FIG. 23c) and F158 FcγRIIIa (FIG. 23d). Binding data are presented in Table 63. The lines through the data represent the linear fits of the data, and the r values indicate the significance of these fits.

FIGS. 24a-24b. Cell-based ADCC assays of select Fc variants in the context of alemtuzumab. ADCC was measured using the DELFIA® EuTDA-based cytotoxicity assay (Perkin Elmer, MA), as described in Example 7, using DoHH-2 lymphoma target cells and 50-fold excess human PBMCs. FIG. 24a is a bar graph showing the raw fluorescence data for the indicated alemtuzumab antibodies at 10 ng/ml. The PBMC bar indicates basal levels of cytotoxicity in the absence of antibody. FIG. 24b shows the dose-dependence of ADCC on antibody concentration for the indicated alemtuzumab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIGS. 25a-25c. Cell-based ADCC assays of select Fc variants in the context of trastuzumab. ADCC was measured using the DELFIA® EuTDA-based cytotoxicity assay, as described in Example 7, using BT474 and Sk-Br-3 breast carcinoma target cells and 50-fold excess human PBMCs. FIG. 25a is a bar graph showing the raw fluorescence data for the indicated trastuzumab antibodies at 1 ng/ml. The PBMC bar indicates basal levels of cytotoxicity in the absence of antibody. FIGS. 25b and 25c show the dose-dependence of ADCC on antibody concentration for the indicated trastuzumab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIGS. 26a-26c. Cell-based ADCC assays of select Fc variants in the context of rituximab. ADCC was measured using the DELFIA® EuTDA-based cytotoxicity assay, as described in Example 7, using WIL2-S lymphoma target cells and 50-fold excess human PBMCs. FIG. 26a is a bar graph showing the raw fluorescence data for the indicated rituximab antibodies at 1 ng/ml. The PBMC bar indicates basal levels of cytotoxicity in the absence of antibody. FIGS. 26b and 26c show the dose-dependence of ADCC on antibody concentration for the indicated rituximab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIGS. 27a-27b. Cell-based ADCC assay of select trastuzumab (FIG. 27a) and rituximab (FIG. 27b) Fc variants showing enhancements in potency and efficacy. Both assays used homozygous F158/F158 FcγRIIIa PBMCs as effector cells at a 25-fold excess to target cells, which were Sk-Br-3 for the trastuzumab assay and WIL2-S for the rituximab assay. Data were normalized according to the absolute minimal lysis for the assay, provided by the fluorescence signal of target cells in the presence of PBMCs alone (no antibody), and the absolute maximal lysis for the assay, provided by the fluorescence signal of target cells in the presence of Triton X1000, as described in Example 7.

FIG. 28. Cell-based ADCC assay of select trastuzumab Fc variants against different cell lines expressing varying levels of the Her2/neu target antigen. ADCC assays were run as described in Example 7, with various cell lines expressing amplified to low levels of Her2/neu receptor, including Sk-Br-3 ($1\times10^6$ copies), SkOV3 (~$1\times10^5$), OVCAR3 (~$1\times10^4$), and MCF-7 (~$3\times10^3$ copies). Human PBMCs allotyped as homozygous F158/F158 FcγRIIIa were used at 25-fold excess to target cells. The bar graph provides ADCC data for WT and Fc variant against the indicated cell lines, normalized to the minimum and maximum fluorescence signal provided by minimal lysis (PBMCs alone) and maximal lysis (Triton X1000).

FIG. 29. Cell-based ADCC assays of select Fc variants in the context of trastuzumab using natural killer (NK) cells as effector cells and measuring LDH release to monitor cell lysis. NK cells, allotyped as heterozygous V158/F158 FcγRIIIa, were at an 8-fold excess to Sk-Br-3 breast carcinoma target cells, and the level of cytotoxicity was measured using the LDH Cytotoxicity Detection Kit, according to the manufacturer's protocol (Roche Diagnostics GmbH, Penzberg, Germany). The graph shows the dose-dependence of ADCC on antibody concentration for the indicated trastuzumab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIG. 30. Cell-based ADCP assay of select variants. The ADCP assay was carried out as described in Example 8, using a co-labeling strategy coupled with flow cytometry. Differentiated macrophages were used as effector cells, and Sk-Br-3 cells were used as target cells. Percent phagocytosis represents the number of co-labeled cells (macrophage+Sk-Br-3) over the total number of Sk-Br-3 in the population (phagocytosed+non-phagocytosed).

FIGS. 31a-31c. Capacity of select Fc variants to mediate binding and activation of complement. FIG. 31a shows an AlphaScreen™ assay measuring binding of select alemtuzumab Fc variants to C1q. The binding data were normalized to the upper and lower baselines for each particular antibody, and the curves represent the fits of the data to a one site competition model. FIGS. 31b and 31c show a cell-based assay measuring capacity of select rituximab Fc variants to mediate CDC. CDC assays were performed using Alamar Blue to monitor lysis of Fc variant and WT rituximab-opsonized WIL2-S lymphoma cells by human serum complement (Quidel, San Diego, Calif.). The dose-dependence on antibody concentration of complement-mediated lysis is shown for the indicated rituximab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIG. 32. AlphaScreen™ assay measuring binding of select alemtuzumab Fc variants to bacterial protein A, as described in Example 10. The binding data were normalized to the upper and lower baselines for each particular antibody, and the curves represent the fits of the data to a one site competition model. PBS was used as a negative control.

FIG. 33. AlphaScreen™ assay measuring binding of select alemtuzumab Fc variants to human FcRn, as described in Example 10. The binding data were normalized to the upper and lower baselines for each particular antibody, and the curves represent the fits of the data to a one site competition model. PBS was used as a negative control.

FIGS. 34a and 34b. AlphaScreen™ assay measuring binding of select alemtuzumab (FIG. 34a) and trastuzumab (FIG. 34b) Fc variants to mouse FcγRIII, as described in Example 11. The binding data were normalized to the upper and lower baselines for each particular antibody, and the curies represent the fits of the data to a one site competition model. PBS was used as a negative control.

FIG. 35. Cell-based ADCC assays of select Fc variants in the context of trastuzumab using mouse PBMCs as effector cells. ADCC was measured using the DELFIA® EuTDA-based cytotoxicity assay using Sk-Br-3 breast carcinoma target cells and 8-fold excess mouse PBMCs. The bar graph shows the raw fluorescence data for the indicated trastuzumab antibodies at 10 ng/ml. The PBMC bar indicates basal levels of cytotoxicity in the absence of antibody, and TX indicates complete cell lysis in the presence of Triton X1000.

FIG. 36. AlphaScreen™ assay measuring binding to human V158 FcγRIIIa by select trastuzumab Fc variants expressed in 293T and CHO cells, as described in Example 12. The binding data were normalized to the upper and lower baselines for each particular antibody, and the curves represent the fits of the data to a one site competition model. PBS was used as a negative control.

FIGS. 37a-37b. Synergy of Fc variants and engineered glycoforms. FIG. 37a presents an AlphaScreen™ assay showing V158 FcγRIIIa binding by WT and Fc variant (V209, S239/I332E/A330L) trastuzumab expressed in 293T, CHO, and Lec-13 CHO cells. The data were normalized to the upper and lower baselines for each antibody, and the curves represent the fits of the data to a one site competition model. PBS was used as a negative control. FIG. 37b presents a cell-based ADCC assay showing the ability of 239T, CHO, and Lec-13 CHO expressed WT and V209 trastuzumab to mediate ADCC. ADCC was measured using the DELFIA® EuTDA-based cytotoxicity assay as described previously, with Sk-Br-3 breast carcinoma target cells. The data show the dose-dependence of ADCC on antibody concentration for the indicated trastuzumab antibodies, normalized to the minimum and maximum fluorescence signal for each particular curve, provided by the baselines at low and high antibody concentrations respectively. The curves represent the fits of the data to a sigmoidal dose-response model using nonlinear regression.

FIGS. 38a-38c. Sequences showing improved anti-CD20 antibodies. The light and heavy chain sequences of rituximab (SEQ ID NOs:3 and 4) are presented in FIG. 38a and FIG. 38b respectively, and are taken from translated Sequence 3 of U.S. Pat. No. 5,736,137. Relevant positions in FIG. 38b are bolded, including S239, V240, V264I, E272, K274, N297, S298, K326, A330, and I332. FIG. 38c shows the improved anti-CD20 antibody heavy chain sequences, with variable positions designated in bold as $X_1, X_2, X_3, X_4, X_5, X_6, X_7, X_8$, $Z_1$, and $Z_2$ (SEQ ID NO:5). The table below the sequence provides possible substitutions for these positions. The improved anti-CD20 antibody sequences comprise at least one non-WT amino acid selected from the group of possible substitutions for $X_1, X_2, X_3, X_4, X_5, X_6, X_7$, and $X_8$. These improved anti-CD20 antibody sequences may also comprise a substitution $Z_1$ and/or $Z_2$. These positions are numbered according to the EU index as in Kabat, and thus do not correspond to the sequential order in the sequence.

DETAILED DESCRIPTION OF THE INVENTION

In order that the invention may be more completely understood, several definitions are set forth below. Such definitions are meant to encompass grammatical equivalents.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell.

By "ADCP" or antibody dependent cell-mediated phacocytosis as used herein is meant the cell-mediated reaction wherein nonspecific cytotoxic cells that express FcγRs recognize bound antibody on a target cell and subsequently cause phagocytosis of the target cell.

By "amino acid modification" herein is meant an amino acid substitution, insertion, and/or deletion in a polypeptide sequence. The preferred amino acid modification herein is a substitution. By "amino acid substitution" or "substitution" herein is meant the replacement of an amino acid at a particular position in a parent polypeptide sequence with another amino acid. For example, the substitution I332E refers to a variant polypeptide, in this case an Fc variant, in which the isoleucine at position 332 is replaced with a glutamic acid.

By "antibody" herein is meant a protein consisting of one or more polypeptides substantially encoded by all or part of the recognized immunoglobulin genes. The recognized immunoglobulin genes, for example in humans, include the kappa (κ), lambda (λ), and heavy chain genetic loci, which together comprise the myriad variable region genes, and the constant region genes mu (υ), delta (δ), gamma (γ), sigma (ε), and alpha (α) which encode the IgM, IgD, IgG, IgE, and IgA isotypes respectively. Antibody herein is meant to include full length antibodies and antibody fragments, and may refer to a natural antibody from any organism, an engineered antibody, or an antibody generated recombinantly for experimental, therapeutic, or other purposes as further defined below. The term "antibody" includes antibody fragments, as are known in the art, such as Fab, Fab', F(ab')$_2$, Fv, scFv, or other antigen-binding subsequences of antibodies, either produced by the modification of whole antibodies or those synthesized de novo using recombinant DNA technologies. Particularly preferred are full length antibodies that comprise Fc variants as described herein. The term "antibody" comprises monoclonal and polyclonal antibodies. Antibodies can be antagonists, agonists, neutralizing, inhibitory, or stimulatory.

The antibodies of the present invention may be nonhuman, chimeric, humanized, or fully human. For a description of the concepts of chimeric and humanized antibodies see Clark et al., 2000 and references cited therein (Clark, 2000, *Immunol Today* 21:397-402). Chimeric antibodies comprise the variable region of a nonhuman antibody, for example VH and VL domains of mouse or rat origin, operably linked to the constant region of a human antibody (see for example U.S. Pat. No. 4,816,567). In a preferred embodiment, the antibodies of the present invention are humanized. By "humanized" antibody as used herein is meant an antibody comprising a human framework region (FR) and one or more complementarity determining regions (CDR's) from a non-human (usually mouse or rat) antibody. The non-human antibody providing the CDR's is called the "donor" and the human immunoglobulin providing the framework is called the "acceptor". Humanization relies principally on the grafting of donor CDRs onto acceptor (human) VL and VH frameworks (Winter U.S. Pat. No. 5,225,539). This strategy is referred to as "CDR grafting". "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213). The humanized antibody optimally also will comprise at least a portion of an immunoglobulin constant region, typically that of a human immunoglobulin, and thus will typically comprise a human Fc region. Methods for humanizing non-human antibodies are well known in the art, and can be essentially performed following the method of Winter and co-workers (Jones et al., 1986, *Nature* 321:522-525; Riechmann et al., 1988, *Nature* 332:323-329; Verhoeyen et al., 1988, *Science,* 239:1534-1536). Additional examples of humanized murine monoclonal antibodies are also known in the art, for example antibodies binding human protein C (O'Connor et al., 1998, *Protein Eng* 11:321-8), interleukin 2 receptor (Queen et al., 1989, Proc Natl Acad Sci, USA 86:10029-33), and human epidermal growth factor receptor 2 (Carter et al., 1992, *Proc Natl Acad Sci USA* 89:4285-9). In an alternate embodiment, the antibodies of the present invention may be fully human, that is the sequences of the antibodies are completely or substantially human. A number of methods are known in the art for generating fully human antibodies, including the use of transgenic mice (Bruggemann et al., 1997, *Curr Opin Biotechnol* 8:455-458) or human antibody libraries coupled with selection methods (Griffiths et al., 1998, *Curr Opin Biotechnol* 9:102-108).

Specifically included within the definition of "antibody" are aglycosylated antibodies. By "aglycosylated antibody" as used herein is meant an antibody that lacks carbohydrate attached at position 297 of the Fc region, wherein numbering is according to the EU system as in Kabat. The aglycosylated antibody may be a deglycosylated antibody, that is an antibody for which the Fc carbohydrate has been removed, for example chemically or enzymatically. Alternatively, the aglycosylated antibody may be a nonglycosylated or unglycosylated antibody, that is an antibody that was expressed without Fc carbohydrate, for example by mutation of one or residues that encode the glycosylation pattern or by expression in an organism that does not attach carbohydrates to proteins, for example bacteria.

Specifically included within the definition of "antibody" are full-length antibodies that contain an Fc variant portion. By "full length antibody" herein is meant the structure that constitutes the natural biological form of an antibody, including variable and constant regions. For example, in most mammals, including humans and mice, the full length antibody of the IgG class is a tetramer and consists of two identical pairs of two immunoglobulin chains, each pair having one light and one heavy chain, each light chain comprising immunoglobulin domains $V_L$ and $C_L$, and each heavy chain comprising immunoglobulin domains $V_H$, Cγ1, Cγ2, and Cγ3. In some mammals, for example in camels and llamas, IgG antibodies may consist of only two heavy chains, each heavy chain comprising a variable domain attached to the Fc region. By "IgG" as used herein is meant a polypeptide belonging to the class of antibodies that are substantially encoded by a recognized immunoglobulin gamma gene. In humans this class comprises IgG1, IgG2, IgG3, and IgG4. In mice this class comprises IgG1, IgG2a, IgG2b, IgG3.

By "amino acid" and "amino acid identity" as used herein is meant one of the 20 naturally occurring amino acids or any non-natural analogues that may be present at a specific, defined position. By "protein" herein is meant at least two covalently attached amino acids, which includes proteins, polypeptides, oligopeptides and peptides. The protein may be made up of naturally occurring amino acids and peptide bonds, or synthetic peptidomimetic structures, i.e. "analogs", such as peptoids (see Simon et al., 1992, *Proc Natl Acad Sci USA* 89(20):9367) particularly when LC peptides are to be administered to a patient. Thus "amino acid", or "peptide residue", as used herein means both naturally occurring and synthetic amino acids. For example, homophenylalanine, citrulline and noreleucine are considered amino acids for the purposes of the invention. "Amino acid" also includes imino acid residues such as proline and hydroxyproline. The side chain may be in either the (R) or the (S) configuration. In the preferred embodiment, the amino acids are in the (S) or L-configuration. If non-naturally occurring side chains are used, non-amino acid substituents may be used, for example to prevent or retard in vivo degradation.

By "computational screening method" herein is meant any method for designing one or more mutations in a protein, wherein said method utilizes a computer to evaluate the energies of the interactions of potential amino acid side chain substitutions with each other and/or with the rest of the protein. As will be appreciated by those skilled in the art, evaluation of energies, referred to as energy calculation, refers to some method of scoring one or more amino acid modifications. Said method may involve a physical or chemical energy term, or may involve knowledge-, statistical-, sequence-based energy terms, and the like. The calculations that compose a computational screening method are herein referred to as "computational screening calculations".

By "effector function" as used herein is meant a biochemical event that results from the interaction of an antibody Fc region with an Fc receptor or ligand. Effector functions include but are not limited to ADCC, ADCP, and CDC. By "effector cell" as used herein is meant a cell of the immune system that expresses one or more Fc receptors and mediates one or more effector functions. Effector cells include but are not limited to monocytes, macrophages, neutrophils, dendritic cells, eosinophils, mast cells, platelets, B cells, large granular lymphocytes, Langerhans' cells, natural killer (NK) cells, and γγ T cells, and may be from any organism including but not limited to humans, mice, rats, rabbits, and monkeys. By "library" herein is meant a set of Fc variants in any form, including but not limited to a list of nucleic acid or amino acid sequences, a list of nucleic acid or amino acid substitutions at variable positions, a physical library comprising nucleic acids that encode the library sequences, or a physical library comprising the Fc variant proteins, either in purified or unpurified form.

By "Fc", "Fc region", FC polypeptide", etc. as used herein is meant an antibody as defined herein that includes the polypeptides comprising the constant region of an antibody excluding the first constant region immunoglobulin domain. Thus Fc refers to the last two constant region immunoglobulin domains of IgA, IgD, and IgG, and the last three constant region immunoglobulin domains of IgE and IgM, and the flexible hinge N-terminal to these domains. For IgA and IgM Fc may include the J chain. For IgG, as illustrated in FIG. 1, Fc comprises immunoglobulin domains Cgamma2 and Cgamma3 (Cγ2 and Cγ3) and the hinge between Cgamma1 (Cγ1) and Cgamma2 (Cγ2). Although the boundaries of the Fc region may vary, the human IgG heavy chain Fc region is usually defined to comprise residues C226 or P230 to its carboxyl-terminus, wherein the numbering is according to the EU index as in Kabat. Fc may refer to this region in isolation, or this region in the context of an antibody, antibody fragment, or Fc fusion. An Fc may be an antibody, Fc fusion, or an protein or protein domain that comprises Fc. Particularly preferred are Fc variants, which are non-naturally occurring variants of an Fc.

By "Fc fusion" as used herein is meant a protein wherein one or more polypeptides is operably linked to an Fc region or a derivative thereof. Fc fusion is herein meant to be synonymous with the terms "immunoadhesin", "Ig fusion", "Ig chimera", and "receptor globulin" (sometimes with dashes) as used in the prior art (Chamow et al., 1996, *Trends Biotechnol* 14:52-60; Ashkenazi et al., 1997, *Curr Opin Immunol* 9:195-200). An Fc fusion combines the Fc region of an immunoglobulin with a fusion partner, which in general can be any protein or small molecule. The role of the non-Fc part of an Fc fusion, i.e. the fusion partner, is to mediate target binding, and thus it is functionally analogous to the variable regions of an antibody. Virtually any protein or small molecule may be linked to Fc to generate an Fc fusion. Protein fusion partners may include, but are not limited to, the target-binding region of a receptor, an adhesion molecule, a ligand, an enzyme, a cytokine, a chemokine, or some other protein or protein domain. Small molecule fusion partners may include any therapeutic agent that directs the Fc fusion to a therapeutic target. Such targets may be any molecule, preferably an extracellular receptor, that is implicated in disease. Two families of surface receptors that are targets of a number of approved small molecule drugs are G-Protein Coupled Receptors (GPCRs), and ion channels, including K+, Na+, Ca+ channels. Nearly 70% of all drugs currently marketed worldwide target GPCRs. Thus the Fc variants of the present invention may be fused to a small molecule that targets, for example, one or more GABA receptors, purinergic receptors, adrenergic receptors, histaminergic receptors, opiod receptors, chemokine receptors, glutamate receptors, nicotinic receptors, the 5HT (serotonin) receptor, and estrogen receptors. A fusion partner may be a small-molecule mimetic of a protein that targets a therapeutically useful target. Specific examples of particular drugs that may serve as Fc fusion partners can be found in L. S. Goodman et al., Eds., *Goodman and Gilman's The Pharmacological Basis of Therapeutics* (McGraw-Hill, New York, ed. 9, 1996). Fusion partners include not only small molecules and proteins that bind known targets for existing drugs, but orphan receptors that do not yet exist as drug targets. The completion of the genome and proteome projects are proving to be a driving force in drug discovery, and these projects have yielded a trove of orphan receptors. There is enormous potential to validate these new molecules as drug targets, and develop protein and small molecule therapeutics that target them. Such protein and small molecule therapeutics are contemplated as Fc fusion partners that employ the Fc variants of the present invention. A variety of linkers, defined and described below, may be used to covalently link Fc to a fusion partner to generate an Fc fusion.

By "Fc gamma receptor" or "FcγR" as used herein is meant any member of the family of proteins that bind the IgG antibody Fc region and are substantially encoded by the FcγR genes. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIIb-NA1 and FcγRIIIb-NA2) (Jefferis et al., 2002, *Immunol Lett* 82:57-65), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "Fc ligand" as used herein is meant a molecule, preferably a polypeptide, from any organism that binds to the Fc region of an antibody to form an Fc-ligand complex. Fc ligands include but are not limited to FcγRs, FcγRs, FcγRs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, *Immunological Reviews* 190:123-136). Fc ligands may include undiscovered molecules that bind Fc.

By "IgG" as used herein is meant a polypeptide belonging to the class of antibodies that are substantially encoded by a recognized immunoglobulin gamma gene. In humans this class comprises IgG1, IgG2, IgG3, and IgG4. In mice this class comprises IgG1, IgG2a, IgG2b, IgG3. By "immunoglobulin (Ig)" herein is meant a protein consisting of one or more polypeptides substantially encoded by immunoglobulin genes. Immunoglobulins include but are not limited to antibodies. Immunoglobulins may have a number of structural forms, including but not limited to full length antibodies, antibody fragments, and individual immunoglobulin domains. By "immunoglobulin (Ig) domain" herein is meant a region of an immunoglobulin that exists as a distinct structural entity as ascertained by one skilled in the art of protein structure. Ig domains typically have a characteristic □-sandwich folding topology. The known Ig domains in the IgG class of antibodies are $V_H$, Cγ1, Cγ2, Cγ3, $V_L$, and $C_L$.

By "parent polypeptide" or "precursor polypeptide" (including Fc parent or precursors) as used herein is meant a polypeptide that is subsequently modified to generate a variant. Said parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "Parent Fc polypeptide" as used herein is meant an unmodified Fc polypeptide that is modified to generate a variant, and by "parent antibody" as used herein is meant an unmodified antibody that is modified to generate a variant antibody.

As outlined above, certain positions of the Fc molecule can be altered. By "position" as used herein is meant a location in the sequence of a protein. Positions may be numbered sequentially, or according to an established format, for example the EU index as in Kabat. For example, position 297 is a position in the human antibody IgG1. Corresponding positions are determined as outlined above, generally through alignment with other parent sequences.

By "residue" as used herein is meant a position in a protein and its associated amino acid identity. For example, Asparagine 297 (also referred to as Asn297, also referred to as N297) is a residue in the human antibody IgG1.

By "target antigen" as used herein is meant the molecule that is bound specifically by the variable region of a given antibody. A target antigen may be a protein, carbohydrate, lipid, or other chemical compound.

By "target cell" as used herein is meant a cell that expresses a target antigen.

By "variable region" as used herein is meant the region of an immunoglobulin that comprises one or more Ig domains substantially encoded by any of the Vκ, Vλ, and/or $V_H$ genes that make up the kappa, lambda, and heavy chain immunoglobulin genetic loci respectively.

By "variant polypeptide" as used herein is meant a polypeptide sequence that differs from that of a parent polypeptide sequence by virtue of at least one amino acid modification. Variant polypeptide may refer to the polypeptide itself, a composition comprising the polypeptide, or the amino sequence that encodes it. Preferably, the variant polypeptide has at least one amino acid modification compared to the parent polypeptide, e.g. from about one to about ten amino acid modifications, and preferably from about one to about five amino acid modifications compared to the parent. The variant polypeptide sequence herein will preferably possess at least about 80% homology with a parent polypeptide sequence, and most preferably at least about 90% homology, more preferably at least about 95% homology. Accordingly, by "Fc variant" as used herein is meant an Fc sequence that differs from that of a parent Fc sequence by virtue of at least one amino acid modification. An Fc variant may only encompass an Fc region, or may exist in the context of an antibody, Fc fusion, or other polypeptide that is substantially encoded by Fc. Fc variant may refer to the Fc polypeptide itself, compositions comprising the Fc variant polypeptide, or the amino acid sequence that encodes it. In a preferred embodiment, the variant proteins of the invention comprise an Fc variant, as described herein, and as such, may comprise an antibody (and the corresponding derivatives) with the Fc variant, or an Fc fusion protein that comprises the Fc variant. In addition, in some cases, the Fc is a variant as compared to a wild-type Fc, or to a "parent" variant.

For all positions discussed in the present invention, numbering of an immunoglobulin heavy chain is according to the EU index (Kabat et al., 1991, *Sequences of Proteins of Immunological Interest,* 5th Ed., United States Public Health Svice, National Institutes of Health, Bethesda). The "EU index as in Kabat" refers to the residue numbering of the human IgG1 EU antibody.

The Fc variants of the present invention may be optimized for a variety of properties. Properties that may be optimized include but are not limited to enhanced or reduced affinity for an FcγR. In a preferred embodiment, the Fc variants of the present invention are optimized to possess enhanced affinity for a human activating FcγR, preferably FcγRI, FcγRIIa, FcγRIIc, FcγRIIIa, and FcγRIIIb, most preferably FcγRIIIa. In an alternately preferred embodiment, the Fc variants are optimized to possess reduced affinity for the human inhibitory receptor FcγRIIb. These preferred embodiments are anticipated to provide antibodies and Fc fusions with enhanced therapeutic properties in humans, for example enhanced effector function and greater anti-cancer potency. In an alternate embodiment, the Fc variants of the present invention are optimized to have reduced or ablated affinity for a human FcγR, including but not limited to FcγRI, FcγRIIa, FcγRIIb, FcγRIIc, FcγRIIIa, and FcγRIIIb. These embodiments are anticipated to provide antibodies and Fc fusions with enhanced therapeutic properties in humans, for example reduced effector function and reduced toxicity. Preferred embodiments comprise optimization of Fc binding to a human FcγR, however in alternate embodiments the Fc variants of the present invention possess enhanced or reduced affinity for FcγRs from nonhuman organisms, including but not limited to mice, rats, rabbits, and monkeys. Fc variants that are optimized for binding to a nonhuman FcγR may find use in experimentation. For example, mouse models are available for a variety of diseases that enable testing of properties such as efficacy, toxicity, and pharmacokinetics for a given drug candidate. As is known in the art, cancer cells can be grafted or injected into mice to mimic a human cancer, a process referred to as xenografting. Testing of antibodies or Fc fusions that comprise Fc variants that are optimized for one or more mouse FcγRs, may provide valuable information with regard to the efficacy of the antibody or Fc fusion, its mechanism of action, and the like. The Fc variants of the present invention may also be optimized for enhanced functionality and/or solution properties in aglycosylated form. In a preferred embodiment, the aglycosylated Fc variants of the present invention bind an Fc ligand with greater affinity than the aglycosylated form of the parent Fc polypeptide. Said Fc ligands include but are not limited to FcγRs, C1q, FcRn, and proteins A and G, and may be from any source including but not limited to human, mouse, rat, rabbit, or monkey, preferably human. In an alternately preferred embodiment, the Fc variants are optimized to be more stable and/or more soluble than the aglycosylated form of the parent Fc polypeptide. An Fc variant that is engineered or predicted to display any of the aforementioned optimized properties is herein referred to as an "optimized Fc variant".

The Fc variants of the present invention may be derived from parent Fc polypeptides that are themselves from a wide range of sources. The parent Fc polypeptide may be substantially encoded by one or more Fc genes from any organism, including but not limited to humans, mice, rats, rabbits, camels, llamas, dromedaries, monkeys, preferably mammals and most preferably humans and mice. In a preferred embodiment, the parent Fc polypeptide composes an antibody, referred to as the parent antibody. The parent antibody may be fully human, obtained for example using transgenic mice (Bruggemann et al., 1997, *Curr Opin Biotechnol* 8:455-458) or human antibody libraries coupled with selection methods (Griffiths et al., 1998, *Curr Opin Biotechnol* 9:102-108). The parent antibody need not be naturally occurring. For example, the parent antibody may be an engineered antibody, including but not limited to chimeric antibodies and humanized antibodies (Clark, 2000, *Immunol Today* 21:397-402). The parent antibody may be an engineered variant of an antibody that is substantially encoded by one or more natural antibody genes. In one embodiment, the parent antibody has been affinity matured, as is known in the art. Alternatively, the antibody has been modified in some other way, for example as described in U.S. Ser. No. 10/339,788, filed on Mar. 3, 2003.

The Fc variants of the present invention may be substantially encoded by immunoglobulin genes belonging to any of the antibody classes. In a preferred embodiment, the Fc variants of the present invention find use in antibodies or Fc fusions that comprise sequences belonging to the IgG class of antibodies, including IgG1, IgG2, IgG3, or IgG4. In an alternate embodiment the Fc variants of the present invention find use in antibodies or Fc fusions that comprise sequences belonging to the IgA (including subclasses IgA1 and IgA2), IgD, IgE, IgG, or IgM classes of antibodies. The Fc variants of the present invention may comprise more than one protein chain. That is, the present invention may find use in an antibody or Fc fusion that is a monomer or an oligomer, including a homo- or hetero-oligomer.

In a preferred embodiment, the antibodies of the invention are based on human sequences, and thus human sequences are used as the "base" sequences, against which other sequences, such as rat, mouse, and monkey sequences are compared. In order to establish homology to primary sequence or structure, the amino acid sequence of a precursor or parent Fc polypeptide is directly compared to the human Fc sequence outlined herein. After aligning the sequences, using one or more of the homology alignment programs known in the art (for example using conserved residues as between species), allowing for necessary insertions and deletions in order to maintain alignment (i.e., avoiding the elimination of conserved residues through arbitrary deletion and insertion), the residues equivalent to particular amino acids in the primary sequence of human Fc are defined. Alignment of conserved residues preferably should conserve 100% of such residues. However, alignment of greater than 75% or as little as 50% of conserved residues is also adequate to define equivalent residues (sometimes referred to as "corresponding residues"). Equivalent residues may also be defined by determining homology at the level of tertiary structure for an Fc polypeptide whose tertiary structure has been determined. Equivalent residues are defined as those for which the atomic coordinates of two or more of the main chain atoms of a particular amino acid residue of the parent or precursor (N on N, CA on, CA, C on C and 0 on 0) are within 0.13 nm and preferably 0.1 nm after alignment. Alignment is achieved after the best model has been oriented and positioned to give the maximum overlap of atomic coordinates of non-hydrogen protein atoms of the Fc polypeptide.

The Fc variants of the present invention may be combined with other Fc modifications, including but not limited to modifications that alter effector function or interaction with one or more Fc ligands. Such combination may provide additive, synergistic, or novel properties in antibodies or Fc fusions. In one embodiment, the Fc variants of the present invention may be combined with other known Fc variants (Duncan et al., 1988, *Nature* 332:563-564; Lund et al, 1991, *J Immunol* 147:2657-2662; Lund et al., 1992, *Mol Immunol* 29:53-59; Alegre et al., 1994, *Transplantation* 57:1537-1543; Hutchins et al., 1995, *Proc Natl Acad Sci USA* 92:11980-11984; Jefferis et al., 1995, *Immunol Lett* 44:111-117; Lund et al., 1995, *Faseb J* 9:115-119; Jefferis et al., 1996, *Immunol Lett* 54:101-104; Lund et al., 1996, *J Immunol* 157:4963-4969; Armour et al., 1999, *Eur J Immunol* 29:2613-2624; Idusogie et al., 2000, *J Immunol* 164:4178-4184; Reddy et al., 2000, *J Immunol* 164:1925-1933; Xu et al., 2000, *Cell Immunol* 200:16-26; Idusogie et al., 2001, *J Immunol* 166:2571-2575; Shields et al., 2001, *J Biol Chem* 276:6591-6604; Jefferis et al., 2002, *Immunol Lett* 82:57-65; Presta et al., 2002, *Biochem Soc Trans* 30:487-490; Hinton et al., 2004, *J Biol Chem* 279:6213-6216) (U.S. Pat. No. 5,624,821; U.S. Pat. No. 5,885,573; U.S. Pat. No. 6,194,551; PCT WO 00/42072; PCT WO 99/58572; US 2004/0002587 A1). In an alternate embodiment, the Fc variants of the present invention are incorporated into an antibody or Fc fusion that comprises one or more engineered glycoforms. By "engineered clycoform" as used herein is meant a carbohydrate composition that is covalently attached to an Fc polypeptide, wherein said carbohydrate composition differs chemically from that of a parent Fc polypeptide. Engineered glycoforms may be useful for a variety of purposes, including but not limited to enhancing or reducing effector function. Engineered glycoforms may be generated by a variety of methods known in the art (Umaña et al., 1999, *Nat Biotechnol* 17:176-180; Davies et al., 2001, *Biotechnol Bioeng* 74:288-294; Shields et al., 2002, *J Biol Chem* 277:26733-26740; Shinkawa et al., 2003, *J Biol Chem* 278:3466-3473); (U.S. Pat. No. 6,602,684; U.S. Ser. No. 10/277,370; U.S. Ser. No. 10/113,929; PCT WO 00/61739A1; PCT WO 01/29246A1; PCT WO 02/31140A1; PCT WO 02/30954A1); (Potelligent™ technology [Biowa, Inc., Princeton, N.J.]; GlycoMAb™ glycosylation engineering technology [GLYCART biotechnology AG, Zurich, Switzerland]). Many of these techniques are based on controlling the level of fucosylated and/or bisecting oligosaccharides that are covalently attached to the Fc region, for example by expressing an Fc polypeptide in various organisms or cell lines, engineered or otherwise (for example Lec-13 CHO cells or rat hybridoma YB2/0 cells), by regulating enzymes involved in the glycosylation pathway (for example FUT8 [α1,6-fucosyltranserase] and/or β1-4-N-acetylglucosaminyltransferase III [GnTIII]), or by modifying carbohydrate(s) after the Fc polypeptide has been expressed. Engineered glycoform typically refers to the different carbohydrate or oligosaccharide; thus an Fc polypeptide, for example an antibody or Fc fusion, may comprise an engineered glycoform. Alternatively, engineered glycoform may refer to the Fc polypeptide that comprises the different carbohydrate or oligosaccharide. Thus combinations of the Fc variants of the present invention with other Fc modifications, as well as undiscovered Fc modifications, are contemplated with the goal of generating novel antibodies or Fc fusions with optimized properties.

The Fc variants of the present invention may find use in an antibody. By "antibody of the present invention" as used herein is meant an antibody that comprises an Fc variant of the present invention. The present invention may, in fact, find use in any protein that comprises Fc, and thus application of the Fc variants of the present invention is not limited to antibodies. The Fc variants of the present invention may find use in an Fc fusion. By "Fc fusion of the present invention" as used herein refers to an Fc fusion that comprises an Fc variant of the present invention. Fc fusions may comprise an Fc variant of the present invention operably linked to a cytokine, soluble receptor domain, adhesion molecule, ligand, enzyme, peptide, or other protein or protein domain, and include but are not limited to Fc fusions described in U.S. Pat. No. 5,843,725; U.S. Pat. No. 6,018,026; U.S. Pat. No. 6,291,212; U.S. Pat. No. 6,291,646; U.S. Pat. No. 6,300,099; U.S. Pat. No. 6,323,323; PCT WO 00/24782; and in (Chamow et al., 1996, *Trends Biotechnol* 14:52-60; Ashkenazi et al., 1997, *Curr Opin Immunol* 9:195-200).

Virtually any antigen may be targeted by the antibodies and fusions of the present invention, including but not limited to the following list of proteins, subunits, domains, motifs, and epitopes belonging to the following list of proteins: CD2; CD3, CD3E, CD4, CD11, CD11a, CD14, CD16, CD18, CD19, CD20, CD22, CD23, CD25, CD28, CD29, CD30, CD32, CD33 (p67 protein), CD38, CD40, CD40L, CD52, CD54, CD56, CD80, CD147, GD3, IL-1, IL-1R, IL-2, IL-2R, IL-4, IL-5, IL-6, IL-6R, IL-8, IL-12, IL-15, IL-18, IL-23, interferon alpha, interferon beta, interferon gamma; TNF-alpha, TNFbeta2, TNFc, TNFalphabeta, TNF-RI, TNF-RII, FasL, CD27L, CD30L, 4-1BBL, TRAIL, RANKL, TWEAK, APRIL, BAFF, LIGHT, VEG1, OX40L, TRAIL Receptor-1, A1 Adenosine Receptor, Lymphotoxin Beta Receptor, TACI, BAFF-R, EPO; LFA-3, ICAM-1, ICAM-3, EpCAM, integrin beta1, integrin beta2, integrin alpha4/beta7, integrin alpha2, integrin alpha3, integrin alpha4, integrin alpha5, integrin alpha6, integrin alphav, alphaVbeta3 integrin, FGFR-3, Keratinocyte Growth Factor, VLA-1, VLA-4, L-selectin, anti-Id, E-selectin, HLA, HLA-DR, CTLA-4, T cell receptor, B7-1, B7-2, VNRintegrin, TGFbeta1, TGFbeta2, eotaxin1, BLyS (B-lymphocyte Stimulator), complement C5, IgE, factor VII, CD64, CBL, NCA 90, EGFR (ErbB-1), Her2/neu (ErbB-2), Her3 (ErbB-3), Her4 (ErbB-4), Tissue Factor, VEGF, VEGFR, endothelin receptor, VLA-4, Hapten NP-cap or NIP-cap, T cell receptor alpha/beta, E-selectin, digoxin, placental alkaline phosphatase (PLAP) and testicular PLAP-like alkaline phosphatase, transferrin receptor, Carcinoembryonic antigen (CEA), CEACAM5, HMFG PEM, mucin MUC1, MUC18, Heparanase I, human cardiac myosin, tumor-associated glycoprotein-72 (TAG-72), tumor-associated antigen CA 125, Prostate specific membrane antigen (PSMA), High molecular weight melanoma-associated antigen (HMW-MAA), carcinoma-associated antigen, Gcoprotein IIb/IIIa (GPIIb/IIIa), tumor-associated antigen expressing Lewis Y related carbohydrate, human cytomegalovirus (HCMV) gH envelope glycoprotein, HIV gp120, HCMV, respiratory syncital virus RSV F, RSVF Fgp, VNRintegrin, IL-8, cytokeratin tumor-associated antigen, Hep B gp120, CMV, gpIIbIIIa, HIV IIIB gp120 V3 loop, respiratory syncytial virus (RSV) Fgp, Herpes simplex virus (HSV) gD glycoprotein, HSV gB glycoprotein, HCMV gB envelope glycoprotein, and Clostridium perfringens toxin.

One skilled in the art will appreciate that the aforementioned list of targets refers not only to specific proteins and biomolecules, but the biochemical pathway or pathways that comprise them. For example, reference to CTLA-4 as a target antigen implies that the ligands and receptors that make up the T cell co-stimulatory pathway, including CTLA-4, B7-1, B7-2, CD28, and any other undiscovered ligands or receptors that bind these proteins, are also targets. Thus target as used herein refers not only to a specific biomolecule, but the set of proteins that interact with said target and the members of the biochemical pathway to which said target belongs. One skilled in the art will further appreciate that any of the aforementioned target antigens, the ligands or receptors that bind them, or other members of their corresponding biochemical pathway, may be operably linked to the Fc variants of the present invention in order to generate an Fc fusion. Thus for example, an Fc fusion that targets EGFR could be constructed by operably linking an Fc variant to EGF, TGFα, or any other ligand, discovered or undiscovered, that binds EGFR. Accordingly, an Fc variant of the present invention could be operably linked to EGFR in order to generate an Fc fusion that binds EGF, TGFα, or any other ligand, discovered or undiscovered, that binds EGFR. Thus virtually any polypeptide, whether a ligand, receptor, or some other protein or protein domain, including but not limited to the aforementioned targets and the proteins that compose their corresponding biochemical pathways, may be operably linked to the Fc variants of the present invention to develop an Fc fusion.

A number of antibodies and Fc fusions that are approved for use, in clinical trials, or in development may benefit from the Fc variants of the present invention. Said antibodies and Fc fusions are herein referred to as "clinical products and candidates". Thus in a preferred embodiment, the Fc variants of the present invention may find use in a range of clinical products and candidates. For example, a number of antibodies that target CD20 may benefit from the Fc variants of the present invention. For example the Fc variants of the present invention may find use in an antibody that is substantially similar to rituximab (Rituxan®, IDEC/Genentech/Roche) (see for example U.S. Pat. No. 5,736,137), a chimeric anti-CD20 antibody approved to treat Non-Hodgkin's lymphoma; HuMax-CD20, an anti-CD20 currently being developed by Genmab, an anti-CD20 antibody described in U.S. Pat. No. 5,500,362, AME-133 (Applied Molecular Evolution), hA20 (Immunomedics, Inc.), and HumaLYM (Intracel). A number of antibodies that target members of the family of epidermal growth factor receptors, including EGFR (ErbB-1), Her2/neu (ErbB-2), Her3 (ErbB-3), Her4 (ErbB-4), may benefit from the Fc variants of the present invention. For example the Fc variants of the present invention may find use in an antibody that is substantially similar to trastuzumab (Herceptin®, Genentech) (see for example U.S. Pat. No. 5,677,171), a humanized anti-Her2/neu antibody approved to treat breast cancer; pertuzumab (rhuMab-2C4, Omnitarg™), currently being developed by Genentech; an anti-Her2 antibody described in U.S. Pat. No. 4,753,894; cetuximab (Erbitux®), Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix/Immunex/Amgen; HuMax-EGFr (U.S. Ser. No. 10/172,317), currently being developed by Genmab; 425, EMD55900, EMD62000, and EMD72000 (Merck KGaA) (U.S. Pat. No. 5,558,864; Murthy et al. 1987, *Arch Biochem Biophys.* 252(2):549-60; Rodeck et al., 1987, *J Cell Biochem.* 35(4):315-20; Kettleborough et al., 1991, *Pro-* tein Eng. 4(7):773-83); ICR62 (Institute of Cancer Research) (PCT WO 95/20045; Modjtahedi et al., 1993, *J. Cell Biophys.* 1993, 22(1-3):129-46; Modjtahedi et al., 1993, *Br J Cancer.* 1993, 67(2):247-53; Modjtahedi et al, 1996, *Br J Cancer,* 73(2):228-35; Modjtahedi et al, 2003, *Int J Cancer,* 105(2): 273-80); TheraCIM hR3 (YM Biosciences, Canada and Centro de Immunologia Molecular, Cuba (U.S. Pat. No. 5,891, 996; U.S. Pat. No. 6,506,883; Mateo et al, 1997, *Immunotechnology,* 3(1):71-81); mAb-806 (Ludwig Institue for Cancer Research, Memorial Sloan-Kettering) (Jungbluth et al. 2003, *Proc Natl Acad Sci USA.* 100(2):639-44); KSB-102 (KS Biomedix); MR1-1 (IVAX, National Cancer Institute) (PCT WO 0162931A2); and SC100 (Scancell) (PCT WO 01/88138). In another preferred embodiment, the Fc variants of the present invention may find use in alemtuzumab (Campath®), Millenium), a humanized monoclonal antibody currently approved for treatment of B-cell chronic lymphocytic leukemia. The Fc variants of the present invention may find use in a variety of antibodies or Fc fusions that are substantially similar to other clinical products and candidates, including but not limited to muromonab-CD3 (Orthoclone OKT3®), an anti-CD3 antibody developed by Ortho Biotech/Johnson & Johnson, ibritumomab tiuxetan (Zevalin®), an anti-CD20 antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/ Lilly, basiliximab (Simulect®), developed by Novartis, palivizumab (Synagis®), developed by Medimmune, infliximab (Remicade®), an anti-TNFalpha antibody developed by Centocor, adalimumab (Humira®), an anti-TNFalpha antibody developed by Abbott, Humicade™, an anti-TNFalpha antibody developed by Celltech, etanercept (Enbrel®), an anti-TNFalpha Fc fusion developed by Immunex/Amgen, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, $^{90}$Y-muHMFG1), an anti-MUC1 In development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF02 antibody being developed by Cambridge Antibody Technology, J695, an anti-IL-12 antibody being developed by Cambridge Antibody Technology and Abbott, CAT-192, an anti-TGFβ1 antibody being developed by Cambridge Antibody Technology and Genzyme, CAT-213, an anti-Eotaxin1 antibody being developed by Cambridge Antibody Technology, LymphoStat-B™ an anti-Blys antibody being developed by Cambridge Antibody Technology and Human Genome Sciences Inc., TRAIL-R1mAb, an anti-TRAIL-R1 antibody being developed by Cambridge Antibody Technology and Human Genome Sciences, Inc., Avastin™ (bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair™ (Omalizumab), an anti-IgE antibody being developed by Genentech, Raptiva™ (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by lmclone, IMC-1C11, an anti-KDR antibody being developed by Imclone, DC101, an anti-flk-1 antibody being developed by lmclone, anti-VE cadherin antibodies being developed by Imclone, CEA-Cide™ (labetuzumab), an anti-carcinoembryonic antigen (CEA) antibody being developed by Immunomedics, LymphoCide™ (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem™ (IDM-1), and anti-Her2 antibody being developed by Medarex and Immuno-Designed Molecules, HuMax™-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/J&J, CNTO 1275, an anti-cytokine antibody being developed by Centocor/J&J, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF™, an anti-gamma interferon antibody being developed by Protein Design Labs, Anti-□5□1 Integrin, being developed by Protein Design Labs, anti-IL-12, being developed by Protein Design Labs, ING-1, an anti-Ep-CAM antibody being developed by Xoma, and MLN01, an anti-Beta2 integrin antibody being developed by Xoma.

Application of the Fc variants to the aforementioned antibody and Fc fusion clinical products and candidates is not meant to be constrained to their precise composition. The Fc variants of the present invention may be incorporated into the aforementioned clinical candidates and products, or into antibodies and Fc fusions that are substantially similar to them. The Fc variants of the present invention may be incorporated into versions of the aforementioned clinical candidates and products that are humanized, affinity matured, engineered, or modified in some other way. Furthermore, the entire polypeptide of the aforementioned clinical products and candidates need not be used to construct a new antibody or Fc fusion that incorporates the Fc variants of the present invention; for example only the variable region of a clinical product or candidate antibody, a substantially similar variable region, or a humanized, affinity matured, engineered, or modified version of the variable region may be used. In another embodiment, the Fc variants of the present invention may find use in an antibody or Fc fusion that binds to the same epitope, antigen, ligand, or receptor as one of the aforementioned clinical products and candidates.

The Fc variants of the present invention may find use in a wide range of antibody and Fc fusion products. In one embodiment the antibody or Fc fusion of the present invention is a therapeutic, a diagnostic, or a research reagent, preferably a therapeutic. Alternatively, the antibodies and Fc fusions of the present invention may be used for agricultural or industrial uses. In an alternate embodiment, the Fc variants of the present invention compose a library that may be screened experimentally. This library may be a list of nucleic acid or amino acid sequences, or may be a physical composition of nucleic acids or polypeptides that encode the library sequences. The Fc variant may find use in an antibody composition that is monoclonal or polyclonal. The antibodies and Fc fusions of the present invention may be agonists, antagonists, neutralizing, inhibitory, or stimulatory. In a preferred embodiment, the antibodies and Fc fusions of the present invention are used to kill target cells that bear the target antigen, for example cancer cells. In an alternate embodiment, the antibodies and Fc fusions of the present invention are used to block, antagonize, or agonize the target antigen, for example for antagonizing a cytokine or cytokine receptor. In an alternately preferred embodiment, the antibodies and Fc fusions of the present invention are used to block, antagonize, or agonize the target antigen and kill the target cells that bear the target antigen.

The Fc variants of the present invention may be used for various therapeutic purposes. In a preferred embodiment, the Fc variant proteins are administered to a patient to treat an antibody-related disorder. A "patient" for the purposes of the present invention includes both humans and other animals, preferably mammals and most preferably humans. Thus the antibodies and Fc fusions of the present invention have both human therapy and veterinary applications. In the preferred embodiment the patient is a mammal, and in the most preferred embodiment the patient is human. The term "treatment" in the present invention is meant to include therapeutic treatment, as well as prophylactic, or suppressive measures for a disease or disorder. Thus, for example, successful administration of an antibody or Fc fusion prior to onset of the disease results in treatment of the disease. As another example, successful administration of an optimized antibody or Fc fusion after clinical manifestation of the disease to combat the symptoms of the disease comprises treatment of the disease. "Treatment" also encompasses administration of an optimized antibody or Fc fusion protein after the appearance of the disease in order to eradicate the disease. Successful administration of an agent after onset and after clinical symptoms have developed, with possible abatement of clinical symptoms and perhaps amelioration of the disease, comprises treatment of the disease. Those "in need of treatment" include mammals already having the disease or disorder, as well as those prone to having the disease or disorder, including those in which the disease or disorder is to be prevented. By "antibody related disorder" or "antibody responsive disorder" or "condition" or "disease" herein are meant a disorder that may be ameliorated by the administration of a pharmaceutical composition comprising an antibody or Fc fusion of the present invention. Antibody related disorders include but are not limited to autoimmune diseases, immunological diseases, infectious diseases, inflammatory diseases, neurological diseases, and oncological and neoplastic diseases including cancer. By "cancer" and "cancerous" herein refer to or describe the physiological condition in mammals that is typically characterized by unregulated cell growth. Examples of cancer include but are not limited to carcinoma, lymphoma, blastoma, sarcoma (including liposarcoma), neuroendocrine tumors, mesothelioma, schwanoma, meningioma, adenocarcinoma, melanoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, testicular cancer, esophageal cancer, tumors of the biliary tract, as well as head and neck cancer. Furthermore, the Fc variants of the present invention may be used to treat conditions including but not limited to congestive heart failure (CHF), vasculitis, rosecea, acne, eczema, myocarditis and other conditions of the myocardium, systemic lupus erythematosus, diabetes, spondylopathies, synovial fibroblasts, and bone marrow stroma; bone loss; Paget's disease, osteoclastoma; multiple myeloma; breast cancer; disuse osteopenia; malnutrition, periodontal disease, Gaucher's disease, Langerhans' cell histiocytosis, spinal cord injury, acute septic arthritis, osteomalacia, Cushing's syndrome, monoostotic fibrous dysplasia, polyostotic fibrous dysplasia, periodontal reconstruction, and bone fractures; sarcoidosis; multiple myeloma; osteolytic bone cancers, breast cancer, lung cancer, kidney cancer and rectal cancer; bone metastasis, bone pain management, and humoral malignant hypercalcemia, ankylosing spondylitisa and other spondyloarthropathies; transplantation rejection, viral infections, hematologic neoplasisas and neoplastic-like conditions for example, Hodgkin's lymphoma; non-Hodgkin's lymphomas (Burkitt's lymphoma, small lymphocytic lymphoma/chronic lymphocytic leukemia, mycosis fungoides, mantle cell lymphoma, follicular lymphoma, diffuse large B-cell lymphoma, marginal zone lymphoma, hairy cell leukemia and lymphoplasmacytic leukemia), tumors of lymphocyte precursor cells, including B-cell acute lymphoblastic leukemia/lymphoma, and T-cell acute lymphoblastic leukemia/lymphoma, thymoma, tumors of the mature T and NK cells, including peripheral T-cell leukemias, adult T-cell leukemia/T-cell lymphomas and large granular lymphocytic leukemia, Langerhans cell histiocytosis, myeloid neoplasias such as acute myelogenous leukemias, including AML with maturation, AML without differentiation, acute promyelocytic leukemia, acute myelomonocytic leukemia, and acute monocytic leukemias, myelodysplastic syndromes, and chronic myeloproliferative disorders, including chronic myelogenous leukemia, tumors of the central nervous system, e.g., brain tumors (glioma, neuroblastoma, astrocytoma, medulloblastoma, ependymoma, and retinoblastoma), solid tumors (nasopharyngeal cancer, basal cell carcinoma, pancreatic cancer, cancer of the bile duct, Kaposi's sarcoma, testicular cancer, uterine, vaginal or cervical cancers, ovarian cancer, primary liver cancer or endometrial cancer, and tumors of the vascular system (angiosarcoma and hemagiopericytoma), osteoporosis, hepatitis, HIV, AIDS, spondyloarthritis, rheumatoid arthritis, inflammatory bowel diseases (IBD), sepsis and septic shock, Crohn's Disease, psoriasis, schleraderma, graft versus host disease (GVHD), allogenic islet graft rejection, hematologic malignancies, such as multiple myeloma (MM), myelodysplastic syndrome (MDS) and acute myelogenous leukemia (AML), inflammation associated with tumors, peripheral nerve injury or demyelinating diseases.

In one embodiment, an antibody or Fc fusion of the present invention is administered to a patient having a disease involving inappropriate expression of a protein. Within the scope of the present invention this is meant to include diseases and disorders characterized by aberrant proteins, due for example to alterations in the amount of a protein present, the presence of a mutant protein, or both. An overabundance may be due to any cause, including but not limited to overexpression at the molecular level, prolonged or accumulated appearance at the site of action, or increased activity of a protein relative to normal. Included within this definition are diseases and disorders characterized by a reduction of a protein. This reduction may be due to any cause, including but not limited to reduced expression at the molecular level, shortened or reduced appearance at the site of action, mutant forms of a protein, or decreased activity of a protein relative to normal. Such an overabundance or reduction of a protein can be measured relative to normal expression, appearance, or activity of a protein, and said measurement may play an important role in the development and/or clinical testing of the antibodies and Fc fusions of the present invention.

In one embodiment, an antibody or Fc fusion of the present invention is the only therapeutically active agent administered to a patient. Alternatively, the antibody or Fc fusion of the present invention is administered in combination with one or more other therapeutic agents, including but not limited to cytotoxic agents, chemotherapeutic agents, cytokines, growth inhibitory agents, anti-hormonal agents, kinase inhibitors, anti-angiogenic agents, cardioprotectants, or other therapeutic agents. Such molecules are suitably present in combination in amounts that are effective for the purpose intended. The skilled medical practitioner can determine empirically the appropriate dose or doses of other therapeutic agents useful herein. The antibodies and Fc fusions of the present invention may be administered concomitantly with one or more other therapeutic regimens. For example, an antibody or Fc fusion of the present invention may be administered to the patient along with chemotherapy, radiation therapy, or both chemotherapy and radiation therapy. In one embodiment, the antibody or Fc fusion of the present invention may be administered in conjunction with one or more antibodies or Fc fusions, which may or may not comprise an Fc variant of the present invention.

In one embodiment, the antibodies and Fc fusions of the present invention are administered with a chemotherapeutic agent. By "chemotherapeutic agent" as used herein is meant a chemical compound useful in the treatment of cancer. Examples of chemotherapeutic agents include but are not limited to alkylating agents such as thiotepa and cyclosphosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, caminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, 5-FU; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elformithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK®; razoxane; sizofuran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxanes, e.g. paclitaxel (TAXOL®, Bristol-Myers Squibb Oncology, Princeton, N.J.) and docetaxel (TAXOTERE®, Rhne-Poulenc Rorer, Antony, France); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; CPT-11; topoisomerase inhibitor RFS 2000; difluoromethylornithine (DMFO); retinoic acid; esperamicins; capecitabine; thymidylate synthase inhibitor (such as Tomudex); cox-2 inhibitors, such as celicoxib (CELEBREX®) or MK-0966 (VIOXX®); and pharmaceutically acceptable salts, acids or derivatives of any of the above. Also included in this definition are anti-hormonal agents that act to regulate or inhibit hormone action on tumors such as anti estrogens including for example tamoxifen, raloxifene, aromatase inhibiting 4(5)-imidazoles, 4-hydroxytamoxifen, trioxifene, keoxifene, LY 117018, onapristone, and toremifene (Fareston); and anti-androgens such as flutamide, nilutamide, bicalutamide, leuprolide, and goserelin; and pharmaceutically acceptable salts, acids or derivatives of any of the above.

A chemotherapeutic or other cytotoxic agent may be administered as a prodrug. By "prodrug" as used herein is meant a precursor or derivative form of a pharmaceutically active substance that is less cytotoxic to tumor cells compared to the parent drug and is capable of being enzymatically activated or converted into the more active parent form. See, for example Wilman, 1986, *Biochemical Society Transactions,* 615th Meeting Belfast, 14:375-382; and Stella et al., "Prodrugs: A Chemical Approach to Targeted Drug Delivery," Directed Drug Delivery, Borchardt et al., (ed.): 247-267, Humana Press, 1985. The prodrugs that may find use with the present invention include but are not limited to phosphate-containing prodrugs, thiophosphate-containing prodrugs, sulfate-containing prodrugs, peptide-containing prodrugs, D-amino acid-modified prodrugs, glycosylated prodrugs, beta-lactam-containing prodrugs, optionally substituted phenoxyacetamide-containing prodrugs or optionally substituted phenylacetamide-containing prodrugs, 5-fluorocytosine and other 5-fluorouridine prodrugs which can be converted into the more active cytotoxic free drug. Examples of cytotoxic drugs that can be derivatized into a prodrug form for use with the antibodies and Fc fusions of the present invention include but are not limited to any of the aforementioned chemotherapeutic agents.

The antibodies and Fc fusions of the present invention may be combined with other therapeutic regimens. For example, in one embodiment, the patient to be treated with the antibody or Fc fusion may also receive radiation therapy. Radiation therapy can be administered according to protocols commonly employed in the art and known to the skilled artisan. Such therapy includes but is not limited to cesium, iridium, iodine, or cobalt radiation. The radiation therapy may be whole body irradiation, or may be directed locally to a specific site or tissue in or on the body, such as the lung, bladder, or prostate. Typically, radiation therapy is administered in pulses over a period of time from about 1 to 2 weeks. The radiation therapy may, however, be administered over longer periods of time. For instance, radiation therapy may be administered to patients having head and neck cancer for about 6 to about 7 weeks. Optionally, the radiation therapy may be administered as a single dose or as multiple, sequential doses. The skilled medical practitioner can determine empirically the appropriate dose or doses of radiation therapy useful herein. In accordance with another embodiment of the invention, the antibody or Fc fusion of the present invention and one or more other anti-cancer therapies are employed to treat cancer cells ex vivo. It is contemplated that such ex vivo treatment may be useful in bone marrow transplantation and particularly, autologous bone marrow transplantation. For instance, treatment of cells or tissue(s) containing cancer cells with antibody or Fc fusion and one or more other anti-cancer therapies, such as described above, can be employed to deplete or substantially deplete the cancer cells prior to transplantation in a recipient patient. It is of course contemplated that the antibodies and Fc fusions of the invention can be employed in combination with still other therapeutic techniques such as surgery.

In an alternate embodiment, the antibodies and Fc fusions of the present invention are administered with a cytokine. By "cytokine" as used herein is meant a generic term for proteins released by one cell population that act on another cell as intercellular mediators. Examples of such cytokines are lymphokines, monokines, and traditional polypeptide hormones. Included among the cytokines are growth hormone such as human growth hormone, N-methionyl human growth hormone, and bovine growth hormone; parathyroid hormone; thyroxine; insulin; proinsulin; relaxin; prorelaxin; glycoprotein hormones such as follicle stimulating hormone (FSH), thyroid stimulating hormone (TSH), and luteinizing hormone (LH); hepatic growth factor; fibroblast growth factor; prolactin; placental lactogen; tumor necrosis factor-alpha and -beta; mullerian-inhibiting substance; mouse gonadotropin-associated peptide; inhibin; activin; vascular endothelial growth factor; integrin; thrombopoietin (TPO); nerve growth factors such as NGF-beta; platelet-growth factor; transforming growth factors (TGFs) such as TGF-alpha and TGF-beta; insulin-like growth factor-I and -II; erythropoietin (EPO); osteoinductive factors; interferons such as interferon-alpha, beta, and -gamma; colony stimulating factors (CSFs) such as macrophage-CSF (M-CSF); granulocyte-macrophage-CSF (GM-CSF); and granulocyte-CSF (G-CSF); interleukins (ILs) such as IL-1, IL-1 alpha, IL-2, IL-3, IL-4, IL-5, IL-6, IL-7, IL-8, IL-9, IL-10, IL-11, IL-12; IL-15, a tumor necrosis factor such as TNF-alpha or TNF-beta; and other polypeptide factors including LIF and kit ligand (KL). As used herein, the term cytokine includes proteins from natural sources or from recombinant cell culture, and biologically active equivalents of the native sequence cytokines.

A variety of other therapeutic agents may find use for administration with the antibodies and Fc fusions of the present invention. In one embodiment, the antibody or Fc fusion is administered with an anti-angiogenic agent. By "anti-angiogenic agent" as used herein is meant a compound that blocks, or interferes to some degree, the development of blood vessels. The anti-angiogenic factor may, for instance, be a small molecule or a protein, for example an antibody, Fc fusion, or cytokine, that binds to a growth factor or growth factor receptor involved in promoting angiogenesis. The preferred anti-angiogenic factor herein is an antibody that binds to Vascular Endothelial Growth Factor (VEGF). In an alternate embodiment, the antibody or Fc fusion is administered with a therapeutic agent that induces or enhances adaptive immune response, for example an antibody that targets CTLA-4. In an alternate embodiment, the antibody or Fc fusion is administered with a tyrosine kinase inhibitor. By "tyrosine kinase inhibitor" as used herein is meant a molecule that inhibits to some extent tyrosine kinase activity of a tyrosine kinase. Examples of such inhibitors include but are not limited to quinazolines, such as PD 153035, 4-(3-chloroanilino)quinazoline; pyridopyrimidines; pyrimidopyrimidines; pyrrolopyrimidines, such as CGP 59326, CGP 60261 and CGP 62706; pyrazolopyrimidines, 4-(phenylamino)-7H-pyrrolo(2,3-d)pyrimidines; curcumin (diferuloyl methane, 4,5-bis(4-fluoroanilino)phthalimide); tyrphostines containing nitrothiophene moieties; PD-0183805 (Warner-Lambert); antisense molecules (e.g. those that bind to ErbB-encoding nucleic acid); quinoxalines (U.S. Pat. No. 5,804,396); tryphostins (U.S. Pat. No. 5,804,396); ZD6474 (Astra Zeneca); PTK-787 (Novartis/Schering A G); pan-ErbB inhibitors such as CI-1033 (Pfizer); Affinitac (ISIS 3521; Isis/Lilly); Imatinib mesylate (ST1571, Gleevec®; Novartis); PKI 166 (Novartis); GW2016 (Glaxo SmithKline); CI-1033 (Pfizer); EKB-569 (Wyeth); Semaxinib (Sugen); ZD6474 (AstraZeneca); PTK-787 (Novartis/Schering AG); INC-1C11 (Imclone); or as described in any of the following patent publications: U.S. Pat. No. 5,804,396; PCT WO 99/09016 (American Cyanimid); PCT WO 98/43960 (American Cyanamid); PCT WO 97/38983 (Warner-Lambert); PCT WO 99/06378 (Warner-Lambert); PCT WO 99/06396 (Warner-Lambert); PCT WO 96/30347 (Pfizer, Inc); PCT WO 96/33978 (AstraZeneca); PCT WO96/3397 (AstraZeneca); PCT WO 96/33980 (AstraZeneca), gefitinib (IRESSA™, ZD1839, AstraZeneca), and OSI-774 (Tarceva™, OSI Pharmaceuticals/Genentech).

A variety of linkers may find use in the present invention to generate Fc fusions (see definition above) or antibody- or Fc fusion-conjugates (see definition below). By "linker", "linker sequence", "spacer", "tethering sequence" or grammatical equivalents thereof, herein is meant a molecule or group of molecules (such as a monomer or polymer) that connects two molecules and often serves to place the two molecules in a preferred configuration. A number of strategies may be used to covalently link molecules together. These include, but are not limited to polypeptide linkages between N- and C-termini of proteins or protein domains, linkage via disulfide bonds, and linkage via chemical cross-linking reagents. In one aspect of this embodiment, the linker is a peptide bond, generated by recombinant techniques or peptide synthesis. Choosing a suitable linker for a specific case where two polypeptide chains are to be connected depends on various parameters, including but not limited to the nature of the two polypeptide chains (e.g., whether they naturally oligomerize), the distance between the N- and the C-termini to be connected if known, and/or the stability of the linker towards proteolysis and oxidation. Furthermore, the linker may contain amino acid residues that provide flexibility. Thus, the linker peptide may predominantly include the following amino acid residues: Gly, Ser, Ala, or Thr. The linker peptide should have a length that is adequate to link two molecules in such a way that they assume the correct conformation relative to one another so that they retain the desired activity. Suitable lengths for this purpose include at least one and not more than 30 amino acid residues. Preferably, the linker is from about 1 to 30 amino acids in length, with linkers of 1, 2, 3, 4, 5, 6, 7, 8, 9, 10, 11, 12, 13, 14, 15, 16, 17, 18 19 and 20 amino acids in length being preferred. In addition, the amino acid residues selected for inclusion in the linker peptide should exhibit properties that do not interfere significantly with the activity of the polypeptide. Thus, the linker peptide on the whole should not exhibit a charge that would be inconsistent with the activity of the polypeptide, or interfere with internal folding, or form bonds or other interactions with amino acid residues in one or more of the monomers that would seriously impede the binding of receptor monomer domains. Useful linkers include glycine-serine polymers (including, for example, (GS)n, (GSGGS)n (SEQ ID NO:6), (GGGGS)n (SEQ ID NO:7) and (GGGS)n (SEQ ID NO:8), where n is an integer of at least one), glycine-alanine polymers, alanine-serine polymers, and other flexible linkers such as the tether for the shaker potassium channel, and a large variety of other flexible linkers, as will be appreciated by those in the art. Glycine-serine polymers are preferred since both of these amino acids are relatively unstructured, and therefore may be able to serve as a neutral tether between components. Secondly, serine is hydrophilic and therefore able to solubilize what could be a globular glycine chain. Third, similar chains have been shown to be effective in joining subunits of recombinant proteins such as single chain antibodies. Suitable linkers may also be identified by screening databases of known three-dimensional structures for naturally occurring motifs that can bridge the gap between two polypeptide chains. In a preferred embodiment, the linker is not immunogenic when administered in a human patient. Thus linkers may be chosen such that they have low immunogenicity or are thought to have low immunogenicity. For example, a linker may be chosen that exists naturally in a human. In a preferred embodiment the linker has the sequence of the hinge region of an antibody, that is the sequence that links the antibody Fab and Fc regions; alternatively the linker has a sequence that comprises part of the hinge region, or a sequence that is substantially similar to the hinge region of an antibody. Another way of obtaining a suitable linker is by optimizing a simple linker, e.g., (Gly4Ser)n, through random mutagenesis. Alternatively, once a suitable polypeptide linker is defined, additional linker polypeptides can be created to select amino acids that more optimally interact with the domains being linked. Other types of linkers that may be used in the present invention include artificial polypeptide linkers and inteins. In another embodiment, disulfide bonds are designed to link the two molecules. In another embodiment, linkers are chemical cross-linking agents. For example, a variety of bifunctional protein coupling agents may be used, including but not limited to N-succinimidyl-3-(2-pyridyidithiol)propionate (SPDP), succinimidyl-4-(N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis(p-azidobenzoyl) hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al., 1971, Science 238:1098. Chemical linkers may enable chelation of an isotope. For example, Carbon-14-labeled 1-isothiocyanatobenzyl-3-methyidiethylene triaminepentaacetic acid (MX-DTPA) is an exemplary chelating agent for conjugation of radionucleotide to the antibody (see PCT WO 94/11026). The linker may be cleavable, facilitating release of the cytotoxic drug in the cell. For example, an acid-labile linker, peptidase-sensitive linker, dimethyl linker or disulfide-containing linker (Chari et al., 1992, Cancer Research 52: 127-131) may be used. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use to link the Fc variants of the present invention to a fusion partner to generate an Fc fusion, or to link the antibodies and Fc fusions of the present invention to a conjugate.

In one embodiment, the antibody or Fc fusion of the present invention is conjugated or operably linked to another therapeutic compound, referred to herein as a conjugate. The conjugate may be a cytotoxic agent, a chemotherapeutic agent, a cytokine, an anti-angiogenic agent, a tyrosine kinase inhibitor, a toxin, a radioisotope, or other therapeutically active agent. Chemotherapeutic agents, cytokines, anti-angiogenic agents, tyrosine kinase inhibitors, and other therapeutic agents have been described above, and all of these aforemention therapeutic agents may find use as antibody or Fc fusion conjugates. In an alternate embodiment, the antibody or Fc fusion is conjugated or operably linked to a toxin, including but not limited to small molecule toxins and enzymatically active toxins of bacterial, fungal, plant or animal origin, including fragments and/or variants thereof. Small molecule toxins include but are not limited to calicheamicin, maytansine (U.S. Pat. No. 5,208,020), trichothene, and CC1065. In one embodiment of the invention, the antibody or Fc fusion is conjugated to one or more maytansine molecules (e.g. about 1 to about 10 maytansine molecules per antibody molecule). Maytansine may, for example, be converted to May-SS-Me which may be reduced to May-SH3 and reacted with modified antibody or Fc fusion (Chari et al., 1992, Cancer Research 52: 127-131) to generate a maytansinoid-antibody or maytansinoid-Fc fusion conjugate. Another conjugate of interest comprises an antibody or Fc fusion conjugated to one or more calicheamicin molecules. The calicheamicin family of antibiotics are capable of producing double-stranded DNA breaks at sub-picomolar concentrations. Structural analogues of calicheamicin that may be used include but are not limited to $\gamma_1^1$, $\alpha_2^1$, $\alpha_3$, N-acetyl-$\gamma_1^1$, PSAG, and $\Theta^1_1$, (Hinman et al., 1993, Cancer Research 53:3336-3342; Lode et al., 1998, Cancer Research 58:2925-2928) (U.S. Pat. No. 5,714,586; U.S. Pat. No. 5,712,374; U.S. Pat. No. 5,264,586; U.S. Pat. No. 5,773,001). Dolastatin 10 analogs such as auristatin E (AE) and monomethylauristatin E (MMAE) may find use as conjugates for the Fc variants of the present invention (Doronina et al., 2003, Nat Biotechnol 21(7):778-84; Francisco et al., 2003 Blood 102(4):1458-65). Useful enyzmatically active toxins include but are not limited to diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin and the tricothecenes. See, for example, PCT WO 93/21232. The present invention further contemplates a conjugate or fusion formed between an antibody or Fc fusion of the present invention and a compound with nucleolytic activity, for example a ribonuclease or DNA endonuclease such as a deoxyribonuclease (DNase).

In an alternate embodiment, an antibody or Fc fusion of the present invention may be conjugated or operably linked to a radioisotope to form a radioconjugate. A variety of radioactive isotopes are available for the production of radioconjugate antibodies and Fc fusions. Examples include, but are not limited to, $At^{211}$, $I^{131}$, $I^{125}$, $Y^{90}$, $Re^{186}$, $Re^{188}$, $Sm^{153}$, $Bi^{212}$, $P^{32}$, and radioactive isotopes of Lu.

In yet another embodiment, an antibody or Fc fusion of the present invention may be conjugated to a "receptor" (such streptavidin) for utilization in tumor pretargeting wherein the antibody-receptor or Fc fusion-receptor conjugate is administered to the patient, followed by removal of unbound conjugate from the circulation using a clearing agent and then administration of a "ligand" (e.g. avidin) which is conjugated to a cytotoxic agent (e.g. a radionucleotide). In an alternate embodiment, the antibody or Fc fusion is conjugated or operably linked to an enzyme in order to employ Antibody Dependent Enzyme Mediated Prodrug Therapy (ADEPT). ADEPT may be used by conjugating or operably linking the antibody or Fc fusion to a prodrug-activating enzyme that converts a prodrug (e.g. a peptidyl chemotherapeutic agent, see PCT WO 81/01145) to an active anti-cancer drug. See, for example, PCT WO 88/07378 and U.S. Pat. No. 4,975,278. The enzyme component of the immunoconjugate useful for ADEPT includes any enzyme capable of acting on a prodrug in such a way so as to covert it into its more active, cytotoxic form. Enzymes that are useful in the method of this invention include but are not limited to alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as serratia protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as .beta.-galactosidase and neuramimidase useful for converting glycosylated prodrugs into free drugs; beta-lactamase useful for converting drugs derivatized with .alpha.-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, for example, Massey, 1987, *Nature* 328: 457-458). Antibody-abzyme and Fc fusion-abzyme conjugates can be prepared for delivery of the abzyme to a tumor cell population.

Other modifications of the antibodies and Fc fusions of the present invention are contemplated herein. For example, the antibody or Fc fusion may be linked to one of a variety of nonproteinaceous polymers, e.g., polyethylene glycol (PEG), polypropylene glycol, polyoxyalkylenes, or copolymers of polyethylene glycol and polypropylene glycol.

Pharmaceutical compositions are contemplated wherein an antibody or Fc fusion of the present invention and and one or more therapeutically active agents are formulated. Formulations of the antibodies and Fc fusions of the present invention are prepared for storage by mixing said antibody or Fc fusion having the desired degree of purity with optional pharmaceutically acceptable carriers, excipients or stabilizers (Remington's Pharmaceutical Sciences 16th edition, Osol, A. Ed., 1980), in the form of lyophilized formulations or aqueous solutions. Acceptable carriers, excipients, or stabilizers are nontoxic to recipients at the dosages and concentrations employed, and include buffers such as phosphate, citrate, acetate, and other organic acids; antioxidants including ascorbic acid and methionine; preservatives (such as octadecyidimethylbenzyl ammonium chloride; hexamethonium chloride; benzalkonium chloride, benzethonium chloride; phenol, butyl orbenzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; sweeteners and other flavoring agents; fillers such as microcrystalline cellulose, lactose, corn and other starches; binding agents; additives; coloring agents; salt-forming counter-ions such as sodium; metal complexes (e.g. Zn-protein complexes); and/or non-ionic surfactants such as TWEEN™, PLURONICS™ or polyethylene glycol (PEG). In a preferred embodiment, the pharmaceutical composition that comprises the antibody or Fc fusion of the present invention is in a water-soluble form, such as being present as pharmaceutically acceptable salts, which is meant to include both acid and base addition salts. "Pharmaceutically acceptable acid addition salt" refers to those salts that retain the biological effectiveness of the free bases and that are not biologically or otherwise undesirable, formed with inorganic acids such as hydrochloric acid, hydrobromic acid, sulfuric acid, nitric acid, phosphoric acid and the like, and organic acids such as acetic acid, propionic acid, glycolic acid, pyruvic acid, oxalic acid, maleic acid, malonic acid, succinic acid, fumaric acid, tartaric acid, citric acid, benzoic acid, cinnamic acid, mandelic acid, methanesulfonic acid, ethanesulfonic acid, p-toluenesulfonic acid, salicylic acid and the like. "Pharmaceutically acceptable base addition salts" include those derived from inorganic bases such as sodium, potassium, lithium, ammonium, calcium, magnesium, iron, zinc, copper, manganese, aluminum salts and the like. Particularly preferred are the ammonium, potassium, sodium, calcium, and magnesium salts. Salts derived from pharmaceutically acceptable organic non-toxic bases include salts of primary, secondary, and tertiary amines, substituted amines including naturally occurring substituted amines, cyclic amines and basic ion exchange resins, such as isopropylamine, trimethylamine, diethylamine, triethylamine, tripropylamine, and ethanolamine. The formulations to be used for in vivo administration are preferrably sterile. This is readily accomplished by filtration through sterile filtration membranes or other methods.

The antibodies and Fc fusions disclosed herein may also be formulated as immunoliposomes. A liposome is a small vesicle comprising various types of lipids, phospholipids and/or surfactant that is useful for delivery of a therapeutic agent to a mammal. Liposomes containing the antibody or Fc fusion are prepared by methods known in the art, such as described in Epstein et al., 1985, *Proc Natl Acad Sci USA*, 82:3688; Hwang et al., 1980, *Proc Natl Acad Sci USA*, 77:4030; U.S. Pat. No. 4,485,045; U.S. Pat. No. 4,544,545; and PCT WO 97/38731. Liposomes with enhanced circulation time are disclosed in U.S. Pat. No. 5,013,556. The components of the liposome are commonly arranged in a bilayer formation, similar to the lipid arrangement of biological membranes. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. A chemotherapeutic agent or other therapeutically active agent is optionally contained within the liposome (Gabizon et al., 1989, *J National Cancer Inst* 81:1484).

The antibodies, Fc fusions, and other therapeutically active agents may also be entrapped in microcapsules prepared by methods including but not limited to coacervation techniques, interfacial polymerization (for example using hydroxymethylcellulose or gelatin-microcapsules, or poly-(methylmethacylate) microcapsules), colloidal drug delivery systems (for example, liposomes, albumin microspheres, microemulsions, nano-particles and nanocapsules), and macroemulsions. Such techniques are disclosed in Remington's Pharmaceutical Sciences 16th edition, Osol, A. Ed., 1980. Sustained-release preparations may be prepared. Suitable examples of sustained-release preparations include semipermeable matrices of solid hydrophobic polymer, which matrices are in the form of shaped articles, e.g. films, or microcapsules. Examples of sustained-release matrices include polyesters, hydrogels (for example poly(2-hydroxyethyl-methacrylate), or poly(vinylalcohol)), polylactides (U.S. Pat. No. 3,773,919), copolymers of L-glutamic acid and gamma ethyl-L-glutamate, non-degradable ethylene-vinyl acetate, degradable lactic acid-glycolic acid copolymers such as the LUPRON DEPOT™ (which are injectable microspheres composed of lactic acid-glycolic acid copolymer and leuprolide acetate), poly-D-(−)-3-hydroxybutyric acid, and Pro-Lease® (commercially available from Alkermes), which is a microsphere-based delivery system composed of the desired bioactive molecule incorporated into a matrix of poly-DL-lactide-co-glycolide (PLG).

The concentration of the therapeutically active antibody or Fc fusion of the present invention in the formulation may vary from about 0.1 to 100 weight %. In a preferred embodiment, the concentration of the antibody or Fc fusion is in the range of 0.003 to 1.0 molar. In order to treat a patient, a therapeutically effective dose of the antibody or Fc fusion of the present invention may be administered. By "therapeutically effective dose" herein is meant a dose that produces the effects for which it is administered. The exact dose will depend on the purpose of the treatment, and will be ascertainable by one skilled in the art using known techniques. Dosages may range from 0.01 to 100 mg/kg of body weight or greater, for example 0.1, 1, 10, or 50 mg/kg of body weight, with 1 to 10 mg/kg being preferred. As is known in the art, adjustments for antibody or Fc fusion degradation, systemic versus localized delivery, and rate of new protease synthesis, as well as the age, body weight, general health, sex, diet, time of administration, drug interaction and the severity of the condition may be necessary, and will be ascertainable with routine experimentation by those skilled in the art.

Administration of the pharmaceutical composition comprising an antibody or Fc fusion of the present invention, preferably in the form of a sterile aqueous solution, may be done in a variety of ways, including, but not limited to orally, subcutaneously, intravenously, intranasally, intraotically, transdermally, topically (e.g., gels, salves, lotions, creams, etc.), intraperitoneally, intramuscularly, intrapulmonary (e.g., AERx® inhalable technology commercially available from Aradigm, or Inhance™ pulmonary delivery system commercially available from Inhale Therapeutics), vaginally, parenterally, rectally, or intraocularly. In some instances, for example for the treatment of wounds, inflammation, etc., the antibody or Fc fusion may be directly applied as a solution or spray. As is known in the art, the pharmaceutical composition may be formulated accordingly depending upon the manner of introduction.

Engineering Methods

The present invention provides engineering methods that may be used to generate Fc variants. A principal obstacle that has hindered previous attempts at Fc engineering is that only random attempts at modification have been possible, due in part to the inefficiency of engineering strategies and methods, and to the low-throughput nature of antibody production and screening. The present invention describes engineering methods that overcome these shortcomings. A variety of design strategies, computational screening methods, library generation methods, and experimental production and screening methods are contemplated. These strategies, approaches, techniques, and methods may be applied individually or in various combinations to engineer optimized Fc variants.

Design Strategies

The most efficient approach to generating Fc variants that are optimized for a desired property is to direct the engineering efforts toward that goal. Accordingly, the present invention teaches design strategies that may be used to engineer optimized Fc variants. The use of a design strategy is meant to guide Fc engineering, but is not meant to constrain an Fc variant to a particular optimized property based on the design strategy that was used to engineer it. At first thought this may seem counterintuitive; however its validity is derived from the enormous complexity of subtle interactions that determine the structure, stability, solubility, and function of proteins and protein-protein complexes. Although efforts can be made to predict which protein positions, residues, interactions, etc. are important for a design goal, often times critical ones are not predictable. Effects on protein structure, stability, solubility, and function, whether favorable or unfavorable, are often unforeseen. Yet there are innumerable amino acid modifications that are detrimental or deleterious to proteins. Thus often times the best approach to engineering comes from generation of protein variants that are focused generally towards a design goal but do not cause detrimental effects. In this way, a principal objective of a design strategy may be the generation of quality diversity. At a simplistic level this can be thought of as stacking the odds in one's favor. As an example, perturbation of the Fc carbohydrate or a particular domain-domain angle, as described below, are valid design strategies for generating optimized Fc variants, despite the fact that how carbohydrate and domain-domain angles determine the properties of Fc is not well understood. By reducing the number of detrimental amino acid modifications that are screened, i.e. by screening quality diversity, these design strategies become practical. Thus the true value of the design strategies taught in the present invention is their ability to direct engineering efforts towards the generation of valuable Fc variants. The specific value of any one resulting variant is determined after experimentation.

One design strategy for engineering Fc variants is provided in which interaction of Fc with some Fc ligand is altered by engineering amino acid modifications at the interface between Fc and said Fc ligand. Fc ligands herein may include but are not limited to FcγRs, C1q, FcRn, protein A or G, and the like. By exploring energetically favorable substitutions at Fc positions that impact the binding interface, variants can be engineered that sample new interface conformations, some of which may improve binding to the Fc ligand, some of which may reduce Fc ligand binding, and some of which may have other favorable properties. Such new interface conformations could be the result of, for example, direct interaction with Fc ligand residues that form the interface, or indirect effects caused by the amino acid modifications such as perturbation of side chain or backbone conformations. Variable positions may be chosen as any positions that are believed to play an important role in determining the conformation of the interface. For example, variable positions may be chosen as the set of residues that are within a certain distance, for example 5 Angstroms (Å), preferrably between 1 and 10 Å, of any residue that makes direct contact with the Fc ligand.

An additional design strategy for generating Fc variants is provided in which the conformation of the Fc carbohydrate at N297 is optimized. Optimization as used in this context is meant to includes conformational and compositional changes in the N297 carbohydrate that result in a desired property, for example increased or reduced affinity for an FcγR. Such a strategy is supported by the observation that the carbohydrate structure and conformation dramatically affect Fc/FcγR and Fc/C1 q binding (Umaña et al., 1999, *Nat Biotechnol* 17:176-180; Davies et al., 2001, *Biotechnol Bioeng* 74:288-294; Mimura et al., 2001, *J Biol Chem* 276:45539-45547; Radaev et al., 2001, *J Biol Chem* 276:16478-16483; Shields et al., 2002, *J Biol Chem* 277:26733-26740; Shinkawa et al., 2003, *J Biol Chem* 278:3466-3473). However the carbohydrate makes no specific contacts with FcγRs. By exploring energetically favorable substitutions at positions that interact with carbohydrate, a quality diversity of variants can be engineered that sample new carbohydrate conformations, some of which may improve and some of which may reduce binding to one or more Fc ligands. While the majority of mutations near the Fc/carbohydrate interface appear to alter carbohydrate conformation, some mutations have been shown to alter the glycosylation composition (Lund et al., 1996, *J Immunol* 157:4963-4969; Jefferis et al., 2002, *Immunol Lett* 82:57-65).

Another design strategy for generating Fc variants is provided in which the angle between the Cγ2 and Cγ3 domains is optimized Optimization as used in this context is meant to describe conformational changes in the Cγ2-Cγ3 domain angle that result in a desired property, for example increased or reduced affinity for an FcγR. This angle is an important determinant of Fc/FcγR affinity (Radaev et al., 2001, *J Biol Chem* 276:16478-16483), and a number of mutations distal to the Fc/FcγR interface affect binding potentially by modulating it (Shields et al., 2001, *J Biol Chem* 276:6591-6604). By exploring energetically favorable substitutions positions that appear to play a key role in determining the Cγ2-Cγ3 angle and the flexibility of the domains relative to one another, a quality diversity of variants can be designed that sample new angles and levels of flexibility, some of which may be optimized for a desired Fc property.

Another design strategy for generating Fc variants is provided in which Fc is reengineered to eliminate the structural and functional dependence on glycosylation. This design strategy involves the optimization of Fc structure, stability, solubility, and/or Fc function (for example affinity of Fc for one or more Fc ligands) in the absence of the N297 carbohydrate. In one approach, positions that are exposed to solvent in the absence of glycosylation are engineered such that they are stable, structurally consistent with Fc structure, and have no tendency to aggregate. The Cγ2 is the only unpaired Ig domain in the antibody (see FIG. 1). Thus the N297 carbohydrate covers up the exposed hydrophobic patch that would normally be the interface for a protein-protein interaction with another Ig domain, maintaining the stability and structural integrity of Fc and keeping the Cγ2 domains from aggregating across the central axis. Approaches for optimizing aglycosylated Fc may involve but are not limited to designing amino acid modifications that enhance aglycoslated Fc stability and/or solubility by incorporating polar and/or charged residues that face inward towards the Cγ2-Cγ2 dimer axis, and by designing amino acid modifications that directly enhance the aglycosylated Fc/FcγR interface or the interface of aglycosylated Fc with some other Fc ligand.

An additional design strategy for engineering Fc variants is provided in which the conformation of the Cγ2 domain is optimized Optimization as used in this context is meant to describe conformational changes in the Cγ2 domain angle that result in a desired property, for example increased or reduced affinity for an FcγR. By exploring energetically favorable substitutions at Cγ2 positions that impact the Cγ2 conformation, a quality diversity of variants can be engineered that sample new Cγ2 conformations, some of which may achieve the design goal. Such new Cγ2 conformations could be the result of, for example, alternate backbone conformations that are sampled by the variant. Variable positions may be chosen as any positions that are believed to play an important role in determining Cγ2 structure, stability, solubility, flexibility, function, and the like. For example, Cγ2 hydrophobic core residues, that is Cγ2 residues that are partially or fully sequestered from solvent, may be reengineered. Alternatively, noncore residues may be considered, or residues that are deemed important for determining backbone structure, stability, or flexibility.

An additional design strategy for Fc optimization is provided in which binding to an FcγR, complement, or some other Fc ligand is altered by modifications that modulate the electrostatic interaction between Fc and said Fc ligand. Such modifications may be thought of as optimization of the global electrostatic character of Fc, and include replacement of neutral amino acids with a charged amino acid, replacement of a charged amino acid with a neutral amino acid, or replacement of a charged amino acid with an amino acid of opposite charge (i.e. charge reversal). Such modifications may be used to effect changes in binding affinity between an Fc and one or more Fc ligands, for example FcγRs. In a preferred embodiment, positions at which electrostatic substitutions might affect binding are selected using one of a variety of well known methods for calculation of electrostatic potentials. In the simplest embodiment, Coulomb's law is used to generate electrostatic potentials as a function of the position in the protein. Additional embodiments include the use of Debye-Huckel scaling to account for ionic strength effects, and more sophisticated embodiments such as Poisson-Boltzmann calculations. Such electrostatic calculations may highlight positions and suggest specific amino acid modifications to achieve the design goal. In some cases, these substitutions may be anticipated to variably affect binding to different Fc ligands, for example to enhance binding to activating FcγRs while decreasing binding affinity to inhibitory FcγRs.

Computational Screening

A principal obstacle to obtaining valuable Fc variants is the difficulty in predicting what amino acid modifications, out of the enormous number of possibilities, will achieve the desired goals. Indeed one of the principle reasons that previous attempts at Fc engineering have failed to produce Fc variants of significant clinical value is that approaches to Fc engineering have thus far involved hit-or-miss approaches. The present invention provides computational screening methods that enable quantitative and systematic engineering of Fc variants. These methods typically use atomic level scoring functions, side chain rotamer sampling, and advanced optimization methods to accurately capture the relationships between protein sequence, structure, and function. Computational screening enables exploration of the entire sequence space of possibilities at target positions by filtering the enormous diversity which results. Variant libraries that are screened computationally are effectively enriched for stable, properly folded, and functional sequences, allowing active optimization of Fc for a desired goal. Because of the overlapping sequence constraints on protein structure, stability, solubility, and function, a large number of the candidates in a library occupy "wasted" sequence space. For example, a large fraction of sequence space encodes unfolded, misfolded, incompletely folded, partially folded, or aggregated proteins. This is particularly relevant for Fc engineering because Ig domains are small beta sheet structures, the engineering of which has proven extremely demanding (Quinn et al., 1994, *Proc Natl Acad Sci USA* 91:8747-8751; Richardson et al., 2002, *Proc Natl Acad Sci USA* 99:2754-2759). Even seemingly harmless substitutions on the surface of a beta sheet can cause severe packing conflicts, dramatically disrupting folding equilibrium (Smith et al., 1995, *Science* 270:980-982); incidentally, alanine is one of the worst beta sheet formers (Minor et al., 1994, *Nature* 371:264-267). The determinants of beta sheet stability and specificity are a delicate balance between an extremely large number of subtle interactions. Computational screening enables the generation of libraries that are composed primarily of productive sequence space, and as a result increases the chances of identifying proteins that are optimized for the design goal. In effect, computational screening yields an increased hit-rate, thereby decreasing the number of variants that must be screened experimentally. An additional obstacle to Fc engineering is the need for active design of correlated or coupled mutations. For example, the greatest Fc/FcγR affinity enhancement observed thus far is S298A/E333A/K334A, obtained by combining three better binders obtained separately in an alanine scan (Shields et al., 2001, *J Biol Chem* 276:6591-6604). Computational screening is capable of generating such a three-fold variant in one experiment instead of three separate ones, and furthermore is able to test the functionality of all 20 amino acids at those positions instead of just alanine. Computational screening deals with such complexity by reducing the combinatorial problem to an experimentally tractable size.

Computational screening, viewed broadly, has four steps: 1) selection and preparation of the protein template structure or structures, 2) selection of variable positions, amino acids to be considered at those positions, and/or selection of rotamers to model considered amino acids, 3) energy calculation, and 4) combinatorial optimization. In more detail, the process of computational screening can be described as follows. A three-dimensional structure of a protein is used as the starting point. The positions to be optimized are identified, which may be the entire protein sequence or subset(s) thereof. Amino acids that will be considered at each position are selected. In a preferred embodiment, each considered amino acid may be represented by a discrete set of allowed conformations, called rotamers. Interaction energies are calculated between each considered amino acid and each other considered amino acid, and the rest of the protein, including the protein backbone and invariable residues. In a preferred embodiment, interaction energies are calculated between each considered amino acid side chain rotamer and each other considered amino acid side chain rotamer and the rest of the protein, including the protein backbone and invariable residues. One or more combinatorial search algorithms are then used to identify the lowest energy sequence and/or low energy sequences.

In a preferred embodiment, the computational screening method used is substantially similar to Protein Design Automation® (PDA®) technology, as is described in U.S. Pat. No. 6,188,965; U.S. Pat. No. 6,269,312; U.S. Pat. No. 6,403,312; U.S. Ser. No. 09/782,004; U.S. Ser. No. 09/927,790; U.S. Ser. No. 10/218,102; PCT WO 98/07254; PCT WO 01/40091; and PCT WO 02/25588. In another preferred embodiment, a computational screening method substantially similar to Sequence Prediction Algorithm™ (SPA™) technology is used, as is described in (Raha et al., 2000, *Protein Sci* 9:1106-1119), U.S. Ser. No. 09/877,695, and U.S. Ser. No. 10/071,859. In another preferred embodiment, the computational screening methods described in U.S. Ser. No. 10/339,788, filed on Mar. 3, 2003, entitled "ANTIBODY OPTIMIZATION", are used. In some embodiments, combinations of different computational screening methods are used, including combinations of PDA® technology and SPA™ technology, as well as combinations of these computational methods in combination with other design tools. Similarly, these computational methods can be used simultaneously or sequentially, in any order.

A template structure is used as input into the computational screening calculations. By "template structure" herein is meant the structural coordinates of part or all of a protein to be optimized. The template structure may be any protein for which a three dimensional structure (that is, three dimensional coordinates for a set of the protein's atoms) is known or may be calculated, estimated, modeled, generated, or determined. The three dimensional structures of proteins may be determined using methods including but not limited to X-ray crystallographic techniques, nuclear magnetic resonance (NMR) techniques, de novo modeling, and homology modeling. If optimization is desired for a protein for which the structure has not been solved experimentally, a suitable structural model may be generated that may serve as the template for computational screening calculations. Methods for generating homology models of proteins are known in the art, and these methods find use in the present invention. See for example, Luo, et al. 2002, *Protein Sci* 11: 1218-1226, Lehmann & Wyss, 2001, *Curr Opin Biotechnol* 12(4):371-5; Lehmann et al., 2000, *Biochim Biophys Acta* 1543(2):408-415; Rath & Davidson, 2000, *Protein Sci*, 9(12):2457-69; Lehmann et al., 2000, *Protein Eng* 13(1):49-57; Desjarlais & Berg, 1993, *Proc Natl Acad Sci USA* 90(6):2256-60; Desjarlais & Berg, 1992, *Proteins* 12(2):101-4; Henikoff & Henikoff, 2000, *Adv Protein Chem* 54:73-97; Henikoff & Henikoff, 1994, *J Mol Biol* 243(4):574-8; Morea et al., 2000, *Methods* 20:267-269. Protein/protein complexes may also be obtained using docking methods. Suitable protein structures that may serve as template structures include, but are not limited to, all of those found in the Protein Data Base compiled and serviced by the Research Collaboratory for Structural Bioinformatics (RCSB, formerly the Brookhaven National Lab).

The template structure may be of a protein that occurs naturally or is engineered. The template structure may be of a protein that is substantially encoded by a protein from any organism, with human, mouse, rat, rabbit, and monkey preferred. The template structure may comprise any of a number of protein structural forms. In a preferred embodiment the template structure comprises an Fc region or a domain or fragment of Fc. In an alternately preferred embodiment the template structure comprises Fc or a domain or fragment of Fc bound to one or more Fc ligands, with an Fc/FcγR complex being preferred. The Fc in the template structure may be glycosylated or unglycosylated. The template structure may comprise more than one protein chain. The template structure may additionally contain nonprotein components, including but not limited to small molecules, substrates, cofactors, metals, water molecules, prosthetic groups, polymers and carbohydrates. In a preferred embodiment, the template structure is a plurality or set of template proteins, for example an ensemble of structures such as those obtained from NMR. Alternatively, the set of template structures is generated from a set of related proteins or structures, or artificially created ensembles. The composition and source of the template structure depends on the engineering goal. For example, for enhancement of human Fc/FcγR affinity, a human Fc/FcγR complex structure or derivative thereof may be used as the template structure. Alternatively, the uncomplexed Fc structure may be used as the template structure. If the goal is to enhance affinity of a human Fc for a mouse FcγR, the template structure may be a structure or model of a human Fc bound to a mouse FcγR.

The template structure may be modified or altered prior to design calculations. A variety of methods for template structure preparation are described in U.S. Pat. No. 6,188,965; U.S. Pat. No. 6,269,312; U.S. Pat. No. 6,403,312; U.S. Ser. No. 09/782,004; U.S. Ser. No. 09/927,790; U.S. Ser. No. 09/877,695; U.S. Ser. No. 10/071,859, U.S. Ser. No. 10/218,102; PCT WO 98/07254; PCT WO 01/40091; and PCT WO 02/25588. For example, in a preferred embodiment, explicit hydrogens may be added if not included within the structure. In an alternate embodiment, energy minimization of the structure is run to relax strain, including strain due to van der Waals clashes, unfavorable bond angles, and unfavorable bond lengths. Alternatively, the template structure is altered using other methods, such as manually, including directed or random perturbations. It is also possible to modify the template structure during later steps of computational screening, including during the energy calculation and combinatorial optimization steps. In an alternate embodiment, the template structure is not modified before or during computational screening calculations.

Once a template structure has been obtained, variable positions are chosen. By "variable position" herein is meant a position at which the amino acid identity is allowed to be altered in a computational screening calculation. As is known in the art, allowing amino acid modifications to be considered only at certain variable positions reduces the complexity of a calculation and enables computational screening to be more directly tailored for the design goal. One or more residues may be variable positions in computational screening calculations. Positions that are chosen as variable positions may be those that contribute to or are hypothesized to contribute to the protein property to be optimized, for example Fc affinity for an FcγR, Fc stability, Fc solubility, and so forth. Residues at variable positions may contribute favorably or unfavorably to a specific protein property. For example, a residue at an Fc/FcγR interface may be involved in mediating binding, and thus this position may be varied in design calculations aimed at improving FC/FcγR affinity. As another example, a residue that has an exposed hydrophobic side chain may be responsible for causing unfavorable aggregation, and thus this position may be varied in design calculations aimed at improving solubility. Variable positions may be those positions that are directly involved in interactions that are determinants of a particular protein property. For example, the FcγR binding site of Fc may be defined to include all residues that contact that particular FγcR. By "contact" herein is meant some chemical interaction between at least one atom of an Fc residue with at least one atom of the bound FcγR, with chemical interaction including, but not limited to van der Waals interactions, hydrogen bond interactions, electrostatic interactions, and hydrophobic interactions. In an alternative embodiment, variable positions may include those positions that are indirectly involved in a protein property, i.e. such positions may be proximal to residues that are known to or hypothesized to contribute to an Fc property. For example, the FcγR binding site of an Fc may be defined to include all Fc residues within a certain distance, for example 4-10 Å, of any Fc residue that is in van der Waals contact with the FcγR. Thus variable positions in this case may be chosen not only as residues that directly contact the FcγR, but also those that contact residues that contact the FcγR and thus influence binding indirectly. The specific positions chosen are dependent on the design strategy being employed.

One or more positions in the template structure that are not variable may be floated. By "floated position" herein is meant a position at which the amino acid conformation but not the amino acid identity is allowed to vary in a computational screening calculation. In one embodiment, the floated position may have the parent amino acid identity. For example, floated positions may be positions that are within a small distance, for example 5 Å, of a variable position residue. In an alternate embodiment, a floated position may have a non-parent amino acid identity. Such an embodiment may find use in the present invention, for example, when the goal is to evaluate the energetic or structural outcome of a specific mutation.

Positions that are not variable or floated are fixed. By "fixed position" herein is meant a position at which the amino acid identity and the conformation are held constant in a computational screening calculation. Positions that may be fixed include residues that are not known to be or hypothesized to be involved in the property to be optimized. In this case the assumption is that there is little or nothing to be gained by varying these positions. Positions that are fixed may also include positions whose residues are known or hypothesized to be important for maintaining proper folding, structure, stability, solubility, and/or biological function. For example, positions may be fixed for residues that interact with a particular Fc ligand or residues that encode a glycosylation site in order to ensure that binding to the Fc ligand and proper glycosylation respectively are not perturbed. Likewise, if stability is being optimized, it may be beneficial to fix positions that directly or indirectly interact with an Fc ligand, for example an FcγR, so that binding is not perturbed. Fixed positions may also include structurally important residues such as cysteines participating in disulfide bridges, residues critical for determining backbone conformation such as proline or glycine, critical hydrogen bonding residues, and residues that form favorable packing interactions.

The next step in computational screening is to select a set of possible amino acid identities that will be considered at each particular variable position. This set of possible amino acids is herein referred to as "considered amino acids" at a variable position. "Amino acids" as used herein refers to the set of natural 20 amino acids and any nonnatural or synthetic analogues. In one embodiment, all 20 natural amino acids are considered. Alternatively, a subset of amino acids, or even only one amino acid is considered at a given variable position. As will be appreciated by those skilled in the art, there is a computational benefit to considering only certain amino acid identities at variable positions, as it decreases the combinatorial complexity of the search. Furthermore, considering only certain amino acids at variable positions may be used to tailor calculations toward specific design strategies. For example, for solubility optimization of aglycosylated Fc, it may be beneficial to allow only polar amino acids to be considered at nonpolar Fc residues that are exposed to solvent in the absence of carbohydrate. Nonnatural amino acids, including synthetic amino acids and analogues of natural amino acids, may also be considered amino acids. For example see Chin et al., 2003, *Science,* 301(5635):964-7; and Chin et al., 2003, *Chem Biol.* 10(6):511-9.

A wide variety of methods may be used, alone or in combination, to select which amino acids will be considered at each position. For example, the set of considered amino acids at a given variable position may be chosen based on the degree of exposure to solvent. Hydrophobic or nonpolar amino acids typically reside in the interior or core of a protein, which are inaccessible or nearly inaccessible to solvent. Thus at variable core positions it may be beneficial to consider only or mostly nonpolar amino acids such as alanine, valine, isoleucine, leucine, phenylalanine, tyrosine, tryptophan, and methionine. Hydrophilic or polar amino acids typically reside on the exterior or surface of proteins, which have a significant degree of solvent accessibility. Thus at variable surface positions it may be beneficial to consider only or mostly polar amino acids such as alanine, serine, threonine, aspartic acid, asparagine, glutamine, glutamic acid, arginine, lysine and histidine. Some positions are partly exposed and partly buried, and are not clearly protein core or surface positions, in a sense serving as boundary residues between core and surface residues. Thus at such variable boundary positions it may be beneficial to consider both nonpolar and polar amino acids such as alanine, serine, threonine, aspartic acid, asparagine, glutamine, glutamic acid, arginine, lysine histidine, valine, isoleucine, leucine, phenylalanine, tyrosine, tryptophan, and methionine. Determination of the degree of solvent exposure at variable positions may be by subjective evaluation or visual inspection of the template structure by one skilled in the art of protein structural biology, or by using a variety of algorithms that are known in the art. Selection of amino acid types to be considered at variable positions may be aided or determined wholly by computational methods, such as calculation of solvent accessible surface area, or using algorithms that assess the orientation of the $C\alpha$-$C\beta$ vectors relative to a solvent accessible surface, as outlined in U.S. Pat. Nos. 6,188,965; 6,269,312; U.S. Pat. No. 6,403,312; U.S. Ser. No. 09/782,004; U.S. Ser. No. 09/927,790; U.S. Ser. No. 10/218,102; PCT WO 98/07254; PCT WO 01/40091; and PCT WO 02/25588. In one embodiment, each variable position may be classified explicitly as a core, surface, or boundary position or a classification substantially similar to core, surface, or boundary.

In an alternate embodiment, selection of the set of amino acids allowed at variable positions may be hypothesis-driven. Hypotheses for which amino acid types should be considered at variable positions may be derived by a subjective evaluation or visual inspection of the template structure by one skilled in the art of protein structural biology. For example, if it is suspected that a hydrogen bonding interaction may be favorable at a variable position, polar residues that have the capacity to form hydrogen bonds may be considered, even if the position is in the core. Likewise, if it is suspected that a hydrophobic packing interaction may be favorable at a variable position, nonpolar residues that have the capacity to form favorable packing interactions may be considered, even if the position is on the surface. Other examples of hypothesis-driven approaches may involve issues of backbone flexibility or protein fold. As is known in the art, certain residues, for example proline, glycine, and cysteine, play important roles in protein structure and stability. Glycine enables greater backbone flexibility than all other amino acids, proline constrains the backbone more than all other amino acids, and cysteines may form disulfide bonds. It may therefore be beneficial to include one or more of these amino acid types to achieve a desired design goal. Alternatively, it may be beneficial to exclude one or more of these amino acid types from the list of considered amino acids.

In an alternate embodiment, subsets of amino acids may be chosen to maximize coverage. In this case, additional amino acids with properties similar to that in the template structure may be considered at variable positions. For example, if the residue at a variable position in the template structure is a large hydrophobic residue, additional large hydrophobic amino acids may be considered at that position. Alternatively, subsets of amino acids may be chosen to maximize diversity. In this case, amino acids with properties dissimilar to those in the template structure may be considered at variable positions. For example, if the residue at a variable position in the template is a large hydrophobic residue, amino acids that are small, polar, etc. may be considered.

As is known in the art, some computational screening methods require only the identity of considered amino acids to be determined during design calculations. That is, no information is required concerning the conformations or possible conformations of the amino acid side chains. Other preferred methods utilize a set of discrete side chain conformations, called rotamers, which are considered for each amino acid. Thus, a set of rotamers may be considered at each variable and floated position. Rotamers may be obtained from published rotamer libraries (see for example, Lovel et al., 2000, *Proteins: Structure Function and Genetics* 40:389-408; Dunbrack & Cohen, 1997, *Protein Science* 6:1661-1681; DeMaeyer et al., 1997, *Folding and Design* 2:53-66; Tuffery et al., 1991, *J Biomol Struct Dyn* 8:1267-1289, Ponder & Richards, 1987, *J Mol Biol* 193:775-791). As is known in the art, rotamer libraries may be backbone-independent or backbone-dependent. Rotamers may also be obtained from molecular mechanics or ab initio calculations, and using other methods. In a preferred embodiment, a flexible rotamer model is used (see Mendes et al., 1999, *Proteins: Structure, Function, and Genetics* 37:530-543). Similarly, artificially generated rotamers may be used, or augment the set chosen for each amino acid and/or variable position. In one embodiment, at least one conformation that is not low in energy is included in the list of rotamers. In an alternate embodiment, the rotamer of the variable position residue in the template structure is included in the list of rotamers allowed for that variable position. In an alternate embodiment, only the identity of each amino acid considered at variable positions is provided, and no specific conformational states of each amino acid are used during design calculations. That is, use of rotamers is not essential for computational screening.

Experimental information may be used to guide the choice of variable positions and/or the choice of considered amino acids at variable positions. As is known in the art, mutagenesis experiments are often carried out to determine the role of certain residues in protein structure and function, for example, which protein residues play a role in determining stability, or which residues make up the interface of a protein-protein interaction. Data obtained from such experiments are useful in the present invention. For example, variable positions for Fc/FcγR affinity enhancement could involve varying all positions at which mutation has been shown to affect binding. Similarly, the results from such an experiment may be used to guide the choice of allowed amino acid types at variable positions. For example, if certain types of amino acid substitutions are found to be favorable, similar types of those amino acids may be considered. In one embodiment, additional amino acids with properties similar to those that were found to be favorable experimentally may be considered at variable positions. For example, if experimental mutation of a variable position at an Fc/FcγR interface to a large hydrophobic residue was found to be favorable, the user may choose to include additional large hydrophobic amino acids at that position in the computational screen. As is known in the art, display and other selection technologies may be coupled with random mutagenesis to generate a list or lists of amino acid substitutions that are favorable for the selected property. Such a list or lists obtained from such experimental work find use in the present invention. For example, positions that are found to be invariable in such an experiment may be excluded as variable positions in computational screening calculations, whereas positions that are found to be more acceptable to mutation or respond favorably to mutation may be chosen as variable positions. Similarly, the results from such experiments may be used to guide the choice of allowed amino acid types at variable positions. For example, if certain types of amino acids arise more frequently in an experimental selection, similar types of those amino acids may be considered. In one embodiment, additional amino acids with properties similar to those that were found to be favorable experimentally may be considered at variable positions. For example, if selected mutations at a variable position that resides at an Fc/FcγR interface are found to be uncharged polar amino acids, the user may choose to include additional uncharged polar amino acids, or perhaps charged polar amino acids, at that position.

Sequence information may also be used to guide choice of variable positions and/or the choice of amino acids considered at variable positions. As is known in the art, some proteins share a common structural scaffold and are homologous in sequence. This information may be used to gain insight into particular positions in the protein family. As is known in the art, sequence alignments are often carried out to determine which protein residues are conserved and which are not conserved. That is to say, by comparing and contrasting alignments of protein sequences, the degree of variability at a position may be observed, and the types of amino acids that occur naturally at positions may be observed. Data obtained from such analyses are useful in the present invention. The benefit of using sequence information to choose variable positions and considered amino acids at variable positions are several fold. For choice of variable positions, the primary advantage of using sequence information is that insight may be gained into which positions are more tolerant and which are less tolerant to mutation. Thus sequence information may aid in ensuring that quality diversity, i.e. mutations that are not deleterious to protein structure, stability, etc., is sampled computationally. The same advantage applies to use of sequence information to select amino acid types considered at variable positions. That is, the set of amino acids that occur in a protein sequence alignment may be thought of as being pre-screened by evolution to have a higher chance than random for being compatible with a protein's structure, stability, solubility, function etc. Thus higher quality diversity is sampled computationally. A second benefit of using sequence information to select amino acid types considered at variable positions is that certain alignments may represent sequences that may be less immunogenic than random sequences. For example, if the amino acids considered at a given variable position are the set of amino acids which occur at that position in an alignment of human protein sequences, those amino acids may be thought of as being pre-screened by nature for generating no or low immune response if the optimized protein is used as a human therapeutic.

The source of the sequences may vary widely, and include one or more of the known databases, including but not limited to the Kabat database (Johnson & Wu, 2001, *Nucleic Acids Res* 29:205-206; Johnson & Wu, 2000, *Nucleic Acids Res* 28:214-218), the IMGT database (IMGT, the international ImMunoGeneTics information system®; Lefranc et al., 1999, *Nucleic Acids Res* 27:209-212; Ruiz et al., 2000 *Nucleic Acids Re.* 28:219-221; Lefranc et al., 2001, *Nucleic Acids Res* 29:207-209; Lefranc et al., 2003, *Nucleic Acids Res* 31:307-310), and VBASE, SwissProt, GenBank and Entrez, and EMBL Nucleotide Sequence Database. Protein sequence information can be obtained, compiled, and/or generated from sequence alignments of naturally occurring proteins from any organism, including but not limited to mammals. Protein sequence information can be obtained from a database that is compiled privately. There are numerous sequence-based alignment programs and methods known in the art, and all of these find use in the present invention for generation of sequence alignments of proteins that comprise Fc and Fc ligands.

Once alignments are made, sequence information can be used to guide choice of variable positions. Such sequence information can relate the variability, natural or otherwise, of a given position. Variability herein should be distinguished from variable position. Variability refers to the degree to which a given position in a sequence alignment shows variation in the types of amino acids that occur there. Variable position, to reiterate, is a position chosen by the user to vary in amino acid identity during a computational screening calculation. Variability may be determined qualitatively by one skilled in the art of bioinformatics. There are also methods known in the art to quantitatively determine variability that may find use in the present invention. The most preferred embodiment measures Information Entropy or Shannon Entropy. Variable positions can be chosen based on sequence information obtained from closely related protein sequences, or sequences that are less closely related.

The use of sequence information to choose variable positions finds broad use in the present invention. For example, if an Fc/FcγR interface position in the template structure is tryptophan, and tryptophan is observed at that position in greater than 90% of the sequences in an alignment, it may be beneficial to leave that position fixed. In contrast, if another interface position is found to have a greater level of variability, for example if five different amino acids are observed at that position with frequencies of approximately 20% each, that position may be chosen as a variable position. In another embodiment, visual inspection of aligned protein sequences may substitute for or aid visual inspection of a protein structure. Sequence information can also be used to guide the choice of amino acids considered at variable positions. Such sequence information can relate to how frequently an amino acid, amino acids, or amino acid types (for example polar or nonpolar, charged or uncharged) occur, naturally or otherwise, at a given position. In one embodiment, the set of amino acids considered at a variable position may comprise the set of amino acids that is observed at that position in the alignment. Thus, the position-specific alignment information is used directly to generate the list of considered amino acids at a variable position in a computational screening calculation. Such a strategy is well known in the art; see for example Lehmann & Wyss, 2001, *Curr Opin Biotechnol* 12(4):371-5; Lehmann et al., 2000, *Biochim Biophys Acta* 1543(2):408-415; Rath & Davidson, 2000, *Protein Sci,* 9(12):2457-69; Lehmann et al., 2000, *Protein Eng* 13(1):49-57; Desjarlais & Berg, 1993, *Proc Nat Acad Sci USA* 90(6):2256-60; Desjarlais & Berg, 1992, *Proteins* 12(2):101-4; Henikoff & Henikoff, 2000, *Adv Protein Chem* 54:73-97; Henikoff & Henikoff, 1994, *J Mol Biol* 243(4):574-8. In an alternate embodiment, the set of amino acids considered at a variable position or positions may comprise a set of amino acids that is observed most frequently in the alignment. Thus, a certain criteria is applied to determine whether the frequency of an amino acid or amino acid type warrants its inclusion in the set of amino acids that are considered at a variable position. As is known in the art, sequence alignments may be analyzed using statistical methods to calculate the sequence diversity at any position in the alignment and the occurrence frequency or probability of each amino acid at a position. Such data may then be used to determine which amino acids types to consider. In the simplest embodiment, these occurrence frequencies are calculated by counting the number of times an amino acid is observed at an alignment position, then dividing by the total number of sequences in the alignment. In other embodiments, the contribution of each sequence, position or amino acid to the counting procedure is weighted by a variety of possible mechanisms. In a preferred embodiment, the contribution of each aligned sequence to the frequency statistics is weighted according to its diversity weighting relative to other sequences in the alignment. A common strategy for accomplishing this is the sequence weighting system recommended by Henikoff and Henikoff (Henikoff & Henikoff, 2000, *Adv Protein Chem* 54:73-97; Henikoff & Henikoff, 1994, *J Mol Biol* 243:574-8. In a preferred embodiment, the contribution of each sequence to the statistics is dependent on its extent of similarity to the target sequence, i.e. the template structure used, such that sequences with higher similarity to the target sequence are weighted more highly. Examples of similarity measures include, but are not limited to, sequence identity, BLOSUM similarity score, PAM matrix similarity score, and BLAST score. In an alternate embodiment, the contribution of each sequence to the statistics is dependent on its known physical or functional properties. These properties include, but are not limited to, thermal and chemical stability, contribution to activity, and solubility. For example, when optimizing aglycosylated Fc for solubility, those sequences in an alignment that are known to be most soluble (for example see Ewert et al., 2003, *J Mol Biol* 325:531-553), will contribute more heavily to the calculated frequencies.

Regardless of what criteria are applied for choosing the set of amino acids in a sequence alignment to be considered at variable positions, use of sequence information to choose considered amino acids finds broad use in the present invention. For example, to optimize Fc solubility by replacing exposed nonpolar surface residues, considered amino acids may be chosen as the set of amino acids, or a subset of those amino acids which meet some criteria, that are observed at that position in an alignment of protein sequences. As another example, one or more amino acids may be added or subtracted subjectively from a list of amino acids derived from a sequence alignment in order to maximize coverage. For example, additional amino acids with properties similar to those that are found in a sequence alignment may be considered at variable positions. For example, if an Fc position that is known to or hypothesized to bind an FcγR is observed to have uncharged polar amino acids in a sequence alignment, the user may choose to include additional uncharged polar amino acids in a computational screening calculation, or perhaps charged polar amino acids, at that position.

In one embodiment, sequence alignment information is combined with energy calculation, as discussed below. For example, pseudo energies can be derived from sequence information to generate a scoring function. The use of a sequence-based scoring function may assist in significantly reducing the complexity of a calculation. However, as is appreciated by those skilled in the art, the use of a sequence-based scoring function alone may be inadequate because sequence information can often indicate misleading correlations between mutations that may in reality be structurally conflicting. Thus, in a preferred embodiment, a structure-based method of energy calculation is used, either alone or in combination with a sequence-based scoring function. That is, preferred embodiments do not rely on sequence alignment information alone as the analysis step.

Energy calculation refers to the process by which amino acid modifications are scored. The energies of interaction are measured by one or more scoring functions. A variety of scoring functions find use in the present invention for calculating energies. Scoring functions may include any number of potentials, herein referred to as the energy terms of a scoring function, including but not limited to a van der Waals potential, a hydrogen bond potential, an atomic solvation potential or other solvation models, a secondary structure propensity potential, an electrostatic potential, a torsional potential, and an entropy potential. At least one energy term is used to score each variable or floated position, although the energy terms may differ depending on the position, considered amino acids, and other considerations. In one embodiment, a scoring function using one energy term is used. In the most preferred embodiment, energies are calculated using a scoring function that contains more than one energy term, for example describing van der Waals, salvation, electrostatic, and hydrogen bond interactions, and combinations thereof. In additional embodiments, additional energy terms include but are not limited to entropic terms, torsional energies, and knowledge-based energies.

A variety of scoring functions are described in U.S. Pat. No. 6,188,965; U.S. Pat. No. 6,269,312; U.S. Pat. No. 6,403,312; U.S. Ser. No. 09/782,004; U.S. Ser. No. 09/927,790; U.S. Ser. No. 09/877,695; U.S. Ser. No. 10/071,859, U.S. Ser. No. 10/218,102; PCT WO 98/07254; PCT WO 01/40091; and PCT WO 02/25588. As will be appreciated by those skilled in the art, scoring functions need not be limited to physico-chemical energy terms. For example, knowledge-based potentials may find use in the computational screening methodology of the present invention. Such knowledge-based potentials may be derived from protein sequence and/or structure statistics including but not limited to threading potentials, reference energies, pseudo energies, homology-based energies, and sequence biases derived from sequence alignments. In a preferred embodiment, a scoring function is modified to include models for immunogenicity, such as functions derived from data on binding of peptides to MHC (Major Htocompatability Complex), that may be used to identify potentially immunogenic sequences (see for example U.S. Ser. No. 09/903,378; U.S. Ser. No. 10/039,170; U.S. Ser. No. 60/222,697; U.S. Ser. No. 10/339,788; PCT WO 01/21823; and PCT WO 02/00165). In one embodiment, sequence alignment information can be used to score amino acid substitutions. For example, comparison of protein sequences, regardless of whether the source of said proteins is human, monkey, mouse, or otherwise, may be used to suggest or score amino acid mutations in the computational screening methodology of the present invention. In one embodiment, as is known in the art, one or more scoring functions may be optimized or "trained" during the computational analysis, and then the analysis re-run using the optimized system. Such altered scoring functions may be obtained for example, by training a scoring function using experimental data. As will be appreciated by those skilled in the art, a number of force fields, which are comprised of one or more energy terms, may serve as scoring functions. Force fields include but are not limited to ab initio or quantum mechanical force fields, semi-empirical force fields, and molecular mechanics force fields. Scoring functions that are knowledge-based or that use statistical methods may find use in the present invention. These methods may be used to assess the match between a sequence and a three-dimensional protein structure, and hence may be used to score amino acid substitutions for fidelity to the protein structure. In one embodiment, molecular dynamics calculations may be used to computationally screen sequences by individually calculating mutant sequence scores.

There are a variety of ways to represent amino acids in order to enable efficient energy calculation. In a preferred embodiment, considered amino acids are represented as rotamers, as described previously, and the energy (or score) of interaction of each possible rotamer at each variable and floated position with the other variable and floated rotamers, with fixed position residues, and with the backbone structure and any non-protein atoms, is calculated. In a preferred embodiment, two sets of interaction energies are calculated for each side chain rotamer at every variable and floated position: the interaction energy between the rotamer and the fixed atoms (the "singles" energy), and the interaction energy between the variable and floated positions rotamer and all other possible rotamers at every other variable and floated position (the "doubles" energy). In an alternate embodiment, singles and doubles energies are calculated for fixed positions as well as for variable and floated positions. In an alternate embodiment, considered amino acids are not represented as rotamers.

An important component of computational screening is the identification of one or more sequences that have a favorable score, i.e. are low in energy. Determining a set of low energy sequences from an extremely large number of possibilities is nontrivial, and to solve this problem a combinatorial optimization algorithm is employed. The need for a combinatorial optimization algorithm is illustrated by examining the number of possibilities that are considered in a typical computational screening calculation. The discrete nature of rotamer sets allows a simple calculation of the number of possible rotameric sequences for a given design problem. A backbone of length n with m possible rotamers per position will have $m^n$ possible rotamer sequences, a number that grows exponentially with sequence length. For very simple calculations, it is possible to examine each possible sequence in order to identify the optimal sequence and/or one or more favorable sequences. However, for a typical design problem, the number of possible sequences (up to $10^{80}$ or more) is sufficiently large that examination of each possible sequence is intractable. A variety of combinatorial optimization algorithms may then be used to identify the optimum sequence and/or one or more favorable sequences. Combinatorial optimization algorithms may be divided into two classes: (1) those that are guaranteed to return the global minimum energy configuration if they converge, and (2) those that are not guaranteed to return the global minimum energy configuration, but which will always return a solution. Examples of the first class of algorithms include but are not limited to Dead-End Elimination (DEE) and Branch & Bound (B&B) (including Branch and Terminate) (Gordon & Mayo, 1999, Structure Fold Des 7:1089-98). Examples of the second class of algorithms include, but are not limited to, Monte Carlo (MC), self-consistent mean field (SCMF), Boltzmann sampling (Metropolis et al., 1953, J Chem Phys 21:1087), simulated annealing (Kirkpatrick et al., 1983, Science, 220:671-680), genetic algorithm (GA), and Fast and Accurate Side-Chain Topology and Energy Refinement (FASTER) (Desmet, et al., 2002, Proteins, 48:31-43). A combinatorial optimization algorithm may be used alone or in conjunction with another combinatorial optimization algorithm.

In one embodiment of the present invention, the strategy for applying a combinatorial optimization algorithm is to find the global minimum energy configuration. In an alternate embodiment, the strategy is to find one or more low energy or favorable sequences. In an alternate embodiment, the strategy is to find the global minimum energy configuration and then find one or more low energy or favorable sequences. For example, as outlined in U.S. Pat. No. 6,269,312, preferred embodiments utilize a Dead End Elimination (DEE) step and a Monte Carlo step. In other embodiments, tabu search algorithms are used or combined with DEE and/or Monte Carlo, among other search methods (see Modern Heuristic Search Methods, edited by V. J. Rayward-Smith et al., 1996, John Wiley & Sons Ltd.; U.S. Ser. No. 10/218,102; and PCT WO 02/25588). In another preferred embodiment, a genetic algorithm may be used; see for example U.S. Ser. No. 09/877,695 and U.S. Ser. No. 10/071,859. As another example, as is more fully described in U.S. Pat. No. 6,188,965; U.S. Pat. No. 6,269,312; U.S. Pat. No. 6,403,312; U.S. Ser. No. 09/782,004; U.S. Ser. No. 09/927,790; U.S. Ser. No. 10/218,102; PCT WO 98/07254; PCT WO 01/40091; and PCT WO 02/25588, the global optimum may be reached, and then further computational processing may occur, which generates additional optimized sequences. In the simplest embodiment, design calculations are not combinatorial. That is, energy calculations are used to evaluate amino acid substitutions individually at single variable positions. For other calculations it is preferred to evaluate amino acid substitutions at more than one variable position. In a preferred embodiment, all possible interaction energies are calculated prior to combinatorial optimization. In an alternatively preferred embodiment, energies may be calculated as needed during combinatorial optimization.

Library Generation

The present invention provides methods for generating libraries that may subsequently be screened experimentally to single out optimized Fc variants. By "library" as used herein is meant a set of one or more Fc variants. Library may refer to the set of variants in any form. In one embodiment, the library is a list of nucleic acid or amino acid sequences, or a list of nucleic acid or amino acid substitutions at variable positions. For example, the examples used to illustrate the present invention below provide libraries as amino acid substitutions at variable positions. In one embodiment, a library is a list of at least one sequence that are Fc variants optimized for a desired property. For example see, Filikov et al., 2002, Protein Sci 11:1452-1461 and Luo et al., 2002, Protein Sci 11:1218-1226. In an alternate embodiment, a library may be defined as a combinatorial list, meaning that a list of amino acid substitutions is generated for each variable position, with the implication that each substitution is to be combined with all other designed substitutions at all other variable positions. In this case, expansion of the combination of all possibilities at all variable positions results in a large explicitly defined library. A library may refer to a physical composition of polypeptides that comprise the Fc region or some domain or fragment of the Fc region. Thus a library may refer to a physical composition of antibodies or Fc fusions, either in purified or unpurified form. A library may refer to a physical composition of nucleic acids that encode the library sequences. Said nucleic acids may be the genes encoding the library members, the genes encoding the library members with any operably linked nucleic acids, or expression vectors encoding the library members together with any other operably linked regulatory sequences, selectable markers, fusion constructs, and/or other elements. For example, the library may be a set of mammalian expression vectors that encode Fc library members, the protein products of which may be subsequently expressed, purified, and screened experimentally. As another example, the library may be a display library. Such a library could, for example, comprise a set of expression vectors that encode library members operably linked to some fusion partner that enables phage display, ribosome display, yeast display, bacterial surface display, and the like.

The library may be generated using the output sequence or sequences from computational screening. As discussed above, computationally generated libraries are significantly enriched in stable, properly folded, and functional sequences relative to randomly generated libraries. As a result, computational screening increases the chances of identifying proteins that are optimized for the design goal. The set of sequences in a library is generally, but not always, significantly different from the parent sequence, although in some cases the library preferably contains the parent sequence. As is known in the art, there are a variety of ways that a library may be derived from the output of computational screening calculations. For example, methods of library generation described in U.S. Pat. No. 6,403,312; U.S. Ser. No. 09/782,004; U.S. Ser. No. 09/927,790; U.S. Ser. No. 10/218,102; PCT WO 01/40091; and PCT WO 02/25588 find use in the present invention. In one embodiment, sequences scoring within a certain range of the global optimum sequence may be included in the library. For example, all sequences within 10 kcal/mol of the lowest energy sequence could be used as the library. In an alternate embodiment, sequences scoring within a certain range of one or more local minima sequences may be used. In a preferred embodiment, the library sequences are obtained from a filtered set. Such a list or set may be generated by a variety of methods, as is known in the art, for example using an algorithm such as Monte Carlo, B&B, or SCMF. For example, the top $10^3$ or the top $10^5$ sequences in the filtered set may comprise the library. Alternatively, the total number of sequences defined by the combination of all mutations may be used as a cutoff criterion for the library. Preferred values for the total number of recombined sequences range from 10 to $10^{20}$, particularly preferred values range from 100 to $10^9$. Alternatively, a cutoff may be enforced when a predetermined number of mutations per position is reached. In some embodiments, sequences that do not make the cutoff are included in the library. This may be desirable in some situations, for instance to evaluate the approach to library generation, to provide controls or comparisons, or to sample additional sequence space. For example, the parent sequence may be included in the library, even if it does not make the cutoff.

Clustering algorithms may be useful for classifying sequences derived by computational screening methods into representative groups. For example, the methods of clustering and their application described in U.S. Ser. No. 10/218,102 and PCT WO 02/25588, find use in the present invention. Representative groups may be defined, for example, by similarity. Measures of similarity include, but are not limited to sequence similarity and energetic similarity. Thus the output sequences from computational screening may be clustered around local minima, referred to herein as clustered sets of sequences. For example, sets of sequences that are close in sequence space may be distinguished from other sets. In one embodiment, coverage within one or a subset of clustered sets may be maximized by including in the library some, most, or all of the sequences that make up one or more clustered sets of sequences. For example, it may be advantageous to maximize coverage within the one, two, or three lowest energy clustered sets by including the majority of sequences within these sets in the library. In an alternate embodiment, diversity across clustered sets of sequences may be sampled by including within a library only a subset of sequences within each clustered set. For example, all or most of the clustered sets could be broadly sampled by including the lowest energy sequence from each clustered set in the library.

Sequence information may be used to guide or filter computationally screening results for generation of a library. As discussed, by comparing and contrasting alignments of protein sequences, the degree of variability at a position and the types of amino acids which occur naturally at that position may be observed. Data obtained from such analyses are useful in the present invention. The benefits of using sequence information have been discussed, and those benefits apply equally to use of sequence information to guide library generation. The set of amino acids that occur in a sequence alignment may be thought of as being pre-screened by evolution to have a higher chance than random at being compatible with a protein's structure, stability, solubility, function, and immunogenicity. The variety of sequence sources, as well as the methods for generating sequence alignments that have been discussed, find use in the application of sequence information to guiding library generation. Likewise, as discussed above, various criteria may be applied to determine the importance or weight of certain residues in an alignment. These methods also find use in the application of sequence information to guide library generation. Using sequence information to guide library generation from the results of computational screening finds broad use in the present invention. In one embodiment, sequence information is used to filter sequences from computational screening output. That is to say, some substitutions are subtracted from the computational output to generate the library. For example the resulting output of a computational screening calculation or calculations may be filtered so that the library includes only those amino acids, or a subset of those amino acids that meet some criteria, for example that are observed at that position in an alignment of sequences. In an alternate embodiment, sequence information is used to add sequences to the computational screening output. That is to say, sequence information is used to guide the choice of additional amino acids that are added to the computational output to generate the library. For example, the output set of amino acids for a given position from a computational screening calculation may be augmented to include one or more amino acids that are observed at that position in an alignment of protein sequences. In an alternate embodiment, based on sequence alignment information, one or more amino acids may be added to or subtracted from the computational screening sequence output in order to maximize coverage or diversity. For example, additional amino acids with properties similar to those that are found in a sequence alignment may be added to the library. For example, if a position is observed to have uncharged polar amino acids in a sequence alignment, additional uncharged polar amino acids may be included in the library at that position.

Libraries may be processed further to generate subsequent libraries. In this way, the output from a computational screening calculation or calculations may be thought of as a primary library. This primary library may be combined with other primary libraries from other calculations or other libraries, processed using subsequent calculations, sequence information, or other analyses, or processed experimentally to generate a subsequent library, herein referred to as a secondary library. As will be appreciated from this description, the use of sequence information to guide or filter libraries, discussed above, is itself one method of generating secondary libraries from primary libraries. Generation of secondary libraries gives the user greater control of the parameters within a library. This enables more efficient experimental screening, and may allow feedback from experimental results to be interpreted more easily, providing a more efficient design/experimentation cycle.

There are a wide variety of methods to generate secondary libraries from primary libraries. For example, U.S. Ser. No. 10/218,102 and PCT WO 02/25588, describes methods for secondary library generation that find use in the present invention. Typically some selection step occurs in which a primary library is processed in some way. For example, in one embodiment a selection step occurs wherein some set of primary sequences are chosen to form the secondary library. In an alternate embodiment, a selection step is a computational step, again generally including a selection step, wherein some subset of the primary library is chosen and then subjected to further computational analysis, including both further computational screening as well as techniques such as "in silico" shuffling or recombination (see, for example U.S. Pat. No. 5,830,721; U.S. Pat. No. 5,811,238; U.S. Pat. No. 5,605,793; and U.S. Pat. No. 5,837,458, error-prone PCR, for example using modified nucleotides; known mutagenesis techniques including the use of multi-cassettes; and DNA shuffling (Crameri et al., 1998, *Nature* 391:288-291; Coco et al., 2001, *Nat Biotechnol* 19:354-9; Coco et al., 2002, *Nat Biotechnol,* 20:1246-50), heterogeneous DNA samples (U.S. Pat. No. 5,939,250); ITCHY (Ostermeier et al., 1999, *Nat Biotechnol* 17:1205-1209); StEP (Zhao et al., 1998, *Nat Biotechnol* 16:258-261), GSSM (U.S. Pat. No. 6,171,820 and U.S. Pat. No. 5,965,408); in vivo homologous recombination, ligase assisted gene assembly, end-complementary PCR, profusion (Roberts & Szostak, 1997, *Proc Natl Acad Sci USA* 94:12297-12302); yeast/bacteria surface display (Lu et al., 1995, *Biotechnology* 13:366-372); Seed & Aruffo, 1987, *Proc Natl Acad Sci USA* 84(10):3365-3369; Boder & Wittrup, 1997, *Nat Biotechnol* 15:553-557). In an alternate embodiment, a selection step occurs that is an experimental step, for example any of the library screening steps below, wherein some subset of the primary library is chosen and then recombined experimentally, for example using one of the directed evolution methods discussed below, to form a secondary library. In a preferred embodiment, the primary library is generated and processed as outlined in U.S. Pat. No. 6,403,312.

Generation of secondary and subsequent libraries finds broad use in the present invention. In one embodiment, different primary libraries may be combined to generate a secondary or subsequent library. In another embodiment, secondary libraries may be generated by sampling sequence diversity at highly mutatable or highly conserved positions. The primary library may be analyzed to determine which amino acid positions in the template protein have high mutational frequency, and which positions have low mutational frequency. For example, positions in a protein that show a great deal of mutational diversity in computational screening may be fixed in a subsequent round of design calculations. A filtered set of the same size as the first would now show diversity at positions that were largely conserved in the first library. Alternatively, the secondary library may be generated by varying the amino acids at the positions that have high numbers of mutations, while keeping constant the positions that do not have mutations above a certain frequency.

This discussion is not meant to constrain generation of libraries subsequent to primary libraries to secondary libraries. As will be appreciated, primary and secondary libraries may be processed further to generate tertiary libraries, quaternary libraries, and so on. In this way, library generation is an iterative process. For example, tertiary libraries may be constructed using a variety of additional steps applied to one or more secondary libraries; for example, further computational processing may occur, secondary libraries may be recombined, or subsets of different secondary libraries may be combined. In a preferred embodiment, a tertiary library may be generated by combining secondary libraries. For example, primary and/or secondary libraries that analyzed different parts of a protein may be combined to generate a tertiary library that treats the combined parts of the protein. In an alternate embodiment, the variants from a primary library may be combined with the variants from another primary library to provide a combined tertiary library at lower computational cost than creating a very long filtered set. These combinations may be used, for example, to analyze large proteins, especially large multi-domain proteins, of which Fc is an example. Thus the above description of secondary library generation applies to generating any library subsequent to a primary library, the end result being a final library that may screened experimentally to obtain protein variants optimized for a design goal. These examples are not meant to constrain generation of secondary libraries to any particular application or theory of operation for the present invention. Rather, these examples are meant to illustrate that generation of secondary libraries, and subsequent libraries such as tertiary libraries and so on, is broadly useful in computational screening methodology for library generation.

Experimental Production and Screening

The present invention provides methods for producing and screening libraries of Fc variants. The described methods are not meant to constrain the present invention to any particular application or theory of operation. Rather, the provided methods are meant to illustrate generally that one or more Fc variants or one or more libraries of Fc variants may be produced and screened experimentally to obtain optimized Fc variants. Fc variants may be produced and screened in any context, whether as an Fc region as precisely defined herein, a domain or fragment thereof, or a larger polypeptide that comprises Fc such as an antibody or Fc fusion. General methods for antibody molecular biology, expression, purification, and screening are described in Antibody Engineering, edited by Duebel & Kontermann, Springer-Verlag, Heidelberg, 2001; and Hayhurst & Georgiou, 2001, *Curr Opin Chem Biol* 5:683-689; Maynard & Georgiou, 2000, *Annu Rev Biomed Eng* 2:339-76; Antibodies: A Laboratory Manual by Harlow & Lane, New York: Cold Spring Harbor Laboratory Press, 1988.

In one embodiment of the present invention, the library sequences are used to create nucleic acids that encode the member sequences, and that may then be cloned into host cells, expressed and assayed, if desired. Thus, nucleic acids, and particularly DNA, may be made that encode each member protein sequence. These practices are carried out using well-known procedures. For example, a variety of methods that may find use in the present invention are described in Molecular Cloning—A Laboratory Manual, $3^{rd}$ Ed. (Maniatis, Cold Spring Harbor Laboratory Press, New York, 2001), and Current Protocols in Molecular Biology (John Wiley & Sons). As will be appreciated by those skilled in the art, the generation of exact sequences for a library comprising a large number of sequences is potentially expensive and time consuming. Accordingly, there are a variety of techniques that may be used to efficiently generate libraries of the present invention. Such methods that may find use in the present invention are described or referenced in U.S. Pat. No. 6,403,312; U.S. Ser. No. 09/782,004; U.S. Ser. No. 09/927,790; U.S. Ser. No. 10/218,102; PCT WO 01/40091; and PCT WO 02/25588. Such methods include but are not limited to gene assembly methods, PCR-based method and methods which use variations of PCR, ligase chain reaction-based methods, pooled oligo methods such as those used in synthetic shuffling, error-prone amplification methods and methods which use oligos with random mutations, classical site-directed mutagenesis methods, cassette mutagenesis, and other amplification and gene synthesis methods. As is known in the art, there are a variety of commercially available kits and methods for gene assembly, mutagenesis, vector subcloning, and the like, and such commercial products find use in the present invention for generating nucleic acids that encode Fc variant members of a library.

The Fc variants of the present invention may be produced by culturing a host cell transformed with nucleic acid, preferably an expression vector, containing nucleic acid encoding the Fc variants, under the appropriate conditions to induce or cause expression of the protein. The conditions appropriate for expression will vary with the choice of the expression vector and the host cell, and will be easily ascertained by one skilled in the art through routine experimentation. A wide variety of appropriate host cells may be used, including but not limited to mammalian cells, bacteria, insect cells, and yeast. For example, a variety of cell lines that may find use in the present invention are described in the ATCC® cell line catalog, available from the American Type Culture Collection.

In a preferred embodiment, the Fc variants are expressed in mammalian expression systems, including systems in which the expression constructs are introduced into the mammalian cells using virus such as retrovirus or adenovirus. Any mammalian cells may be used, with human, mouse, rat, hamster, and primate cells being particularly preferred. Suitable cells also include known research cells, including but not limited to Jurkat T cells, NIH3T3, CHO, COS, and 293 cells. In an alternately preferred embodiment, library proteins are expressed in bacterial cells. Bacterial expression systems are well known in the art, and include *Escherichia coli* (*E. coli*), *Bacillus subtilis*, *Streptococcus cremoris*, and *Streptococcus lividans*. In alternate embodiments, Fc variants are produced in insect cells or yeast cells. In an alternate embodiment, Fc variants are expressed in vitro using cell free translation systems. In vitro translation systems derived from both prokaryotic (e.g. *E. coli*) and eukaryotic (e.g. wheat germ, rabbit reticulocytes) cells are available and may be chosen based on the expression levels and functional properties of the protein of interest. For example, as appreciated by those skilled in the art, in vitro translation is required for some display technologies, for example ribosome display. In addition, the Fc variants may be produced by chemical synthesis methods.

The nucleic acids that encode the Fc variants of the present invention may be incorporated into an expression vector in order to express the protein. A variety of expression vectors may be utilized for protein expression. Expression vectors may comprise self-replicating extra-chromosomal vectors or vectors which integrate into a host genome. Expression vectors are constructed to be compatible with the host cell type. Thus expression vectors which find use in the present invention include but are not limited to those which enable protein expression in mammalian cells, bacteria, insect cells, yeast, and in in vitro systems. As is known in the art, a variety of expression vectors are available, commercially or otherwise, that may find use in the present invention for expressing Fc variant proteins.

Expression vectors typically comprise a protein operably linked with control or regulatory sequences, selectable markers, any fusion partners, and/or additional elements. By "operably linked" herein is meant that the nucleic acid is placed into a functional relationship with another nucleic acid sequence. Generally, these expression vectors include transcriptional and translational regulatory nucleic acid operably linked to the nucleic acid encoding the Fc variant, and are typically appropriate to the host cell used to express the protein. In general, the transcriptional and translational regulatory sequences may include promoter sequences, ribosomal binding sites, transcriptional start and stop sequences, translational start and stop sequences, and enhancer or activator sequences. As is also known in the art, expression vectors typically contain a selection gene or marker to allow the selection of transformed host cells containing the expression vector. Selection genes are well known in the art and will vary with the host cell used.

Fc variants may be operably linked to a fusion partner to enable targeting of the expressed protein, purification, screening, display, and the like. Fusion partners may be linked to the Fc variant sequence via a linker sequences. The linker sequence will generally comprise a small number of amino acids, typically less than ten, although longer linkers may also be used. Typically, linker sequences are selected to be flexible and resistant to degradation. As will be appreciated by those skilled in the art, any of a wide variety of sequences may be used as linkers. For example, a common linker sequence comprises the amino acid sequence GGGGS (SEQ ID NO:7). A fusion partner may be a targeting or signal sequence that directs Fc variant protein and any associated fusion partners to a desired cellular location or to the extracellular media. As is known in the art, certain signaling sequences may target a protein to be either secreted into the growth media, or into the periplasmic space, located between the inner and outer membrane of the cell. A fusion partner may also be a sequence that encodes a peptide or protein that enables purification and/or screening. Such fusion partners include but are not limited to polyhistidine tags (His-tags) (for example $H_6$ and $H_{10}$ or other tags for use with Immobilized Metal Affinity Chromatography (IMAC) systems (e.g. $Ni^{+2}$ affinity columns)), GST fusions, MBP fusions, Strep-tag, the BSP biotinylation target sequence of the bacterial enzyme BirA, and epitope tags which are targeted by antibodies (for example c-myc tags, flag-tags, and the like). As will be appreciated by those skilled in the art, such tags may be useful for purification, for screening, or both. For example, an Fc variant may be purified using a His-tag by immobilizing it to a $Ni^{+2}$ affinity column, and then after purification the same His-tag may be used to immobilize the antibody to a $Ni^{+2}$ coated plate to perform an ELISA or other binding assay (as described below). A fusion partner may enable the use of a selection method to screen Fc variants (see below). Fusion partners that enable a variety of selection methods are well-known in the art, and all of these find use in the present invention. For example, by fusing the members of an Fc variant library to the gene III protein, phage display can be employed (Kay et al., Phage display of peptides and proteins: a laboratory manual, Academic Press, San Diego, Calif., 1996; Lowman et al., 1991, *Biochemistry* 30:10832-10838; Smith, 1985, *Science* 228:1315-1317). Fusion partners may enable Fc variants to be labeled. Alternatively, a fusion partner may bind to a specific sequence on the expression vector, enabling the fusion partner and associated Fc variant to be linked covalently or noncovalently with the nucleic acid that encodes them. For example, U.S. Ser. No. 09/642,574; U.S. Ser. No. 10/080,376; U.S. Ser. No. 09/792,630; U.S. Ser. No. 10/023,208; U.S. Ser. No. 09/792,626; U.S. Ser. No. 10/082,671; U.S. Ser. No. 09/953,351; U.S. Ser. No. 10/097,100; U.S. Ser. No. 60/366,658; PCT WO 00/22906; PCT WO 01/49058; PCT WO 02/04852; PCT WO 02/04853; PCT WO 02/08023; PCT WO 01/28702; and PCT WO 02/07466 describe such a fusion partner and technique that may find use in the present invention.

The methods of introducing exogenous nucleic acid into host cells are well known in the art, and will vary with the host cell used. Techniques include but are not limited to dextran-mediated transfection, calcium phosphate precipitation, calcium chloride treatment, polybrene mediated transfection, protoplast fusion, electroporation, viral or phage infection, encapsulation of the polynucleotide(s) in liposomes, and direct microinjection of the DNA into nuclei. In the case of mammalian cells, transfection may be either transient or stable.

In a preferred embodiment, Fc variant proteins are purified or isolated after expression. Proteins may be isolated or purified in a variety of ways known to those skilled in the art. Standard purification methods include chromatographic techniques, including ion exchange, hydrophobic interaction, affinity, sizing or gel filtration, and reversed-phase, carried out at atmospheric pressure or at high pressure using systems such as FPLC and HPLC. Purification methods also include electrophoretic, immunological, precipitation, dialysis, and chromatofocusing techniques. Ultrafiltration and diafiltration techniques, in conjunction with protein concentration, are also useful. As is well known in the art, a variety of natural proteins bind Fc and antibodies, and these proteins can find use in the present invention for purification of Fc variants. For example, the bacterial proteins A and G bind to the Fc region. Likewise, the bacterial protein L binds to the Fab region of some antibodies, as of course does the antibody's target antigen. Purification can often be enabled by a particular fusion partner. For example, Fc variant proteins may be purified using glutathione resin if a GST fusion is employed, $Ni^{+2}$ affinity chromatography if a His-tag is employed, or immobilized anti-flag antibody if a flag-tag is used. For general guidance in suitable purification techniques, see Protein Purification: Principles and Practice, $3^{rd}$ Ed., Scopes, Springer-Verlag, NY, 1994. The degree of purification necessary will vary depending on the screen or use of the Fc variants. In some instances no purification is necessary. For example in one embodiment, if the Fc variants are secreted, screening may take place directly from the media. As is well known in the art, some methods of selection do not involve purification of proteins. Thus, for example, if a library of Fc variants is made into a phage display library, protein purification may not be performed.

Fc variants may be screened using a variety of methods, including but not limited to those that use in vitro assays, in vivo and cell-based assays, and selection technologies. Automation and high-throughput screening technologies may be utilized in the screening procedures. Screening may employ the use of a fusion partner or label. The use of fusion partners has been discussed above. By "labeled" herein is meant that the Fc variants of the invention have one or more elements, isotopes, or chemical compounds attached to enable the detection in a screen. In general, labels fall into three classes: a) immune labels, which may be an epitope incorporated as a fusion partner that is recognized by an antibody, b) isotopic labels, which may be radioactive or heavy isotopes, and c) small molecule labels, which may include fluorescent and colorimetric dyes, or molecules such as biotin that enable other labeling methods. Labels may be incorporated into the compound at any position and may be incorporated in vitro or in vivo during protein expression.

In a preferred embodiment, the functional and/or biophysical properties of Fc variants are screened in an in vitro assay. In vitro assays may allow a broad dynamic range for screening properties of interest. Properties of Fc variants that may be screened include but are not limited to stability, solubility, and affinity for Fc ligands, for example FcγRs. Multiple properties may be screened simultaneously or individually. Proteins may be purified or unpurified, depending on the requirements of the assay. In one embodiment, the screen is a qualitative or quantitative binding assay for binding of Fc variants to a protein or nonprotein molecule that is known or thought to bind the Fc variant. In a preferred embodiment, the screen is a binding assay for measuring binding to the antibody's or Fc fusions' target antigen. In an alternately preferred embodiment, the screen is an assay for binding of Fc variants to an Fc ligand, including but are not limited to the family of FcγRs, the neonatal receptor FcRn, the complement protein C1q, and the bacterial proteins A and G. Said Fc ligands may be from any organism, with humans, mice, rats, rabbits, and monkeys preferred. Binding assays can be carried out using a variety of methods known in the art, including but not limited to FRET (Fluorescence Resonance Energy Transfer) and BRET (Bioluminescence Resonance Energy Transfer)-based assays, AlphaScreen™ (Amplified Luminescent Proximity Homogeneous Assay), Scintillation Proximity Assay, ELISA (Enzyme-Linked Immunosorbent Assay), SPR (Surface Plasmon Resonance, also known as BIACORE®), isothermal titration calorimetry, differential scanning calorimetry, gel electrophoresis, and chromatography including gel filtration. These and other methods may take advantage of some fusion partner or label of the Fc variant. Assays may employ a variety of detection methods including but not limited to chromogenic, fluorescent, luminescent, or isotopic labels.

The biophysical properties of Fc variant proteins, for example stability and solubility, may be screened using a variety of methods known in the art. Protein stability may be determined by measuring the thermodynamic equilibrium between folded and unfolded states. For example, Fc variant proteins of the present invention may be unfolded using chemical denaturant, heat, or pH, and this transition may be monitored using methods including but not limited to circular dichroism spectroscopy, fluorescence spectroscopy, absorbance spectroscopy, NMR spectroscopy, calorimetry, and proteolysis. As will be appreciated by those skilled in the art, the kinetic parameters of the folding and unfolding transitions may also be monitored using these and other techniques. The solubility and overall structural integrity of an Fc variant protein may be quantitatively or qualitatively determined using a wide range of methods that are known in the art. Methods which may find use in the present invention for characterizing the biophysical properties of Fc variant proteins include gel electrophoresis, chromatography such as size exclusion chromatography and reversed-phase high performance liquid chromatography, mass spectrometry, ultraviolet absorbance spectroscopy, fluorescence spectroscopy, circular dichroism spectroscopy, isothermal titration calorimetry, differential scanning calorimetry, analytical ultra-centrifugation, dynamic light scattering, proteolysis, and cross-linking, turbidity measurement, filter retardation assays, immunological assays, fluorescent dye binding assays, protein-staining assays, microscopy, and detection of aggregates via ELISA or other binding assay. Structural analysis employing X-ray crystallographic techniques and NMR spectroscopy may also find use. In one embodiment, stability and/or solubility may be measured by determining the amount of protein solution after some defined period of time. In this assay, the protein may or may not be exposed to some extreme condition, for example elevated temperature, low pH, or the presence of denaturant. Because function typically requires a stable, soluble, and/or well-folded/structured protein, the aforementioned functional and binding assays also provide ways to perform such a measurement. For example, a solution comprising an Fc variant could be assayed for its ability to bind target antigen, then exposed to elevated temperature for one or more defined periods of time, then assayed for antigen binding again. Because unfolded and aggregated protein is not expected to be capable of binding antigen, the amount of activity remaining provides a measure of the Fc variant's stability and solubility.

In a preferred embodiment, the library is screened using one or more cell-based or in vivo assays. For such assays, Fc variant proteins, purified or unpurified, are typically added exogenously such that cells are exposed to individual variants or pools of variants belonging to a library. These assays are typically, but not always, based on the function of an antibody or Fc fusion that comprises the Fc variant; that is, the ability of the antibody or Fc fusion to bind a target antigen and mediate some biochemical event, for example effector function, ligand/receptor binding inhibition, apoptosis, and the like. Such assays often involve monitoring the response of cells to antibody or Fc fusion, for example cell survival, cell death, change in cellular morphology, or transcriptional activation such as cellular expression of a natural gene or reporter gene. For example, such assays may measure the ability of Fc variants to elicit ADCC, ADCP, or CDC. For some assays additional cells or components, that is in addition to the target cells, may need to be added, for example example serum complement, or effector cells such as peripheral blood monocytes (PBMCs), NK cells, macrophages, and the like. Such additional cells may be from any organism, preferably humans, mice, rat, rabbit, and monkey. Antibodies and Fc fusions may cause apoptosis of certain cell lines expressing the antibody's target antigen, or they may mediate attack on target cells by immune cells which have been added to the assay. Methods for monitoring cell death or viability are known in the art, and include the use of dyes, immunochemical, cytochemical, and radioactive reagents. For example, caspase staining assays may enable apoptosis to be measured, and uptake or release of radioactive substrates or fluorescent dyes such as alamar blue may enable cell growth or activation to be monitored. In a preferred embodiment, the DELFIA® EuTDA-based cytotoxicity assay (Perkin Elmer, MA) is used. Alternatively, dead or damaged target cells may be monitoried by measuring the release of one or more natural intracellular proteins, for example lactate dehydrogenase. Transcriptional activation may also serve as a method for assaying function in cell-based assays. In this case, response may be monitored by assaying for natural genes or proteins which may be upregulated, for example the release of certain interleukins may be measured, or alternatively readout may be via a reporter construct. Cell-based assays may also involve the measure of morphological changes of cells as a response to the presence of an Fc variant. Cell types for such assays may be prokaryotic or eukaryotic, and a variety of cell lines that are known in the art may be employed.

Alternatively, cell-based screens are performed using cells that have been transformed or transfected with nucleic acids encoding the Fc variants. That is, Fc variant proteins are not added exogenously to the cells. For example, in one embodiment, the cell-based screen utilizes cell surface display. A fusion partner can be employed that enables display of Fc variants on the surface of cells (Witrrup, 2001, *Curr Opin Biotechnol,* 12:395-399). Cell surface display methods that may find use in the present invention include but are not limited to display on bacteria (Georgiou et al., 1997, *Nat Biotechnol* 15:29-34; Georgiou et al., 1993, *Trends Biotechnol* 11:6-10; Lee et al., 2000, *Nat Biotechnol* 18:645-648; Jun et al., 1998, *Nat Biotechnol* 16:576-80), yeast (Boder & Wittrup, 2000, *Methods Enzymol* 328:430-44; Boder & Wittrup, 1997, *Nat Biotechnol* 15:553-557), and mammalian cells (Whitehorn et al., 1995, *Bio/technology* 13:1215-1219). In an alternate embodiment, Fc variant proteins are not displayed on the surface of cells, but rather are screened intracellularly or in some other cellular compartment. For example, periplasmic expression and cytometric screening (Chen et al., 2001, *Nat Biotechnol* 19: 537-542), the protein fragment complementation assay (Johnsson & Varshavsky, 1994, *Proc Natl Acad Sci USA* 91:10340-10344; Pelletier et al., 1998, *Proc Natl Acad Sci USA* 95:12141-12146), and the yeast two hybrid screen (Fields & Song, 1989, *Nature* 340:245-246) may find use in the present invention. Alternatively, if a polypeptide that comprises the Fc variants, for example an antibody or Fc fusion, imparts some selectable growth advantage to a cell, this property may be used to screen or select for Fc variants.

As is known in the art, a subset of screening methods are those that select for favorable members of a library. Said methods are herein referred to as "selection methods", and these methods find use in the present invention for screening Fc variant libraries. When libraries are screened using a selection method, only those members of a library that are favorable, that is which meet some selection criteria, are propagated, isolated, and/or observed. As will be appreciated, because only the most fit variants are observed, such methods enable the screening of libraries that are larger than those screenable by methods that assay the fitness of library members individually. Selection is enabled by any method, technique, or fusion partner that links, covalently or noncovalently, the phenotype of an Fc variant with its genotype, that is the function of an Fc variant with the nucleic acid that encodes it. For example the use of phage display as a selection method is enabled by the fusion of library members to the gene III protein. In this way, selection or isolation of variant proteins that meet some criteria, for example binding affinity for an FcγR, also selects for or isolates the nucleic acid that encodes it. Once isolated, the gene or genes encoding Fc variants may then be amplified. This process of isolation and amplification, referred to as panning, may be repeated, allowing favorable Fc variants in the library to be enriched. Nucleic acid sequencing of the attached nucleic acid ultimately allows for gene identification.

A variety of selection methods are known in the art that may find use in the present invention for screening Fc variant libraries. These include but are not limited to phage display (Phage display of peptides and proteins: a laboratory manual, Kay et al., 1996, Academic Press, San Diego, Calif., 1996; Lowman et al., 1991, *Biochemistry* 30:10832-10838; Smith, 1985, *Science* 228:1315-1317) and its derivatives such as selective phage infection (Malmborg et al., 1997, *J Mol Biol* 273:544-551), selectively infective phage (Krebber et al., 1997, *J Mol Biol* 268:619-630), and delayed infectivity panning (Benhar et al., 2000, *J Mol Biol* 301:893-904), cell surface display (Witrrup, 2001, *Curr Opin Biotechnol,* 12:395-399) such as display on bacteria (Georgiou et al., 1997, *Nat Biotechnol* 15:29-34; Georgiou et al., 1993, *Trends Biotechnol* 11:6-10; Lee et al., 2000, *Nat Biotechnol* 18:645-648; Jun et al., 1998, *Nat Biotechnol* 16:576-80), yeast (Boder & Wittrup, 2000, *Methods Enzymol* 328:430-44; Boder & Wittrup, 1997, *Nat Biotechnol* 15:553-557), and mammalian cells (Whitehorn et al., 1995, *Bio/technology* 13:1215-1219), as well as in vitro display technologies (Amstutz et al., 2001, *Curr Opin Biotechnol* 12:400-405) such as polysome display (Mattheakis et al., 1994, *Proc Natl Acad Sci USA* 91:9022-9026), ribosome display (Hanes et al., 1997, *Proc Natl Acad Sci USA* 94:4937-4942), mRNA display (Roberts & Szostak, 1997, *Proc Natl Acad Sci USA* 94:12297-12302; Nemoto et al., 1997, *FEBS Lett* 414:405-408), and ribosome-inactivation display system (Zhou et al., 2002, *J Am Chem Soc* 124, 538-543)

Other selection methods that may find use in the present invention include methods that do not rely on display, such as in vivo methods including but not limited to periplasmic expression and cytometric screening (Chen et al., 2001, *Nat Biotechnol* 19:537-542), the protein fragment complementation assay (Johnsson & Varshavsky, 1994, *Proc Natl Acad Sci USA* 91:10340-10344; Pelletier et al., 1998, *Proc Natl Acad Sci USA* 95:12141-12146), and the yeast two hybrid screen (Fields & Song, 1989, *Nature* 340:245-246) used in selection mode (Visintin et al., 1999, *Proc Natl Acad Sci USA* 96:11723-11728). In an alternate embodiment, selection is enabled by a fusion partner that binds to a specific sequence on the expression vector, thus linking covalently or noncovalently the fusion partner and associated Fc variant library member with the nucleic acid that encodes them. For example, U.S. Ser. No. 09/642,574; U.S. Ser. No. 10/080,376; U.S. Ser. No. 09/792,630; U.S. Ser. No. 10/023,208; U.S. Ser. No. 09/792,626; U.S. Ser. No. 10/082,671; U.S. Ser. No. 09/953,351; U.S. Ser. No. 10/097,100; U.S. Ser. No. 60/366,658; PCT WO 00/22906; PCT WO 01/49058; PCT WO 02/04852; PCT WO 02/04853; PCT WO 02/08023; PCT WO 01/28702; and PCT WO 02/07466 describe such a fusion partner and technique that may find use in the present invention. In an alternative embodiment, in vivo selection can occur if expression of a polypeptide that comprises the Fc variant, such as an antibody or Fc fusion, imparts some growth, reproduction, or survival advantage to the cell.

A subset of selection methods referred to as "directed evolution" methods are those that include the mating or breading of favorable sequences during selection, sometimes with the incorporation of new mutations. As will be appreciated by those skilled in the art, directed evolution methods can facilitate identification of the most favorable sequences in a library, and can increase the diversity of sequences that are screened. A variety of directed evolution methods are known in the art that may find use in the present invention for screening Fc variant libraries, including but not limited to DNA shuffling (PCT WO 00/42561 A3; PCT WO 01/70947 A3), exon shuffling (U.S. Pat. No. 6,365,377; Kolkman & Stemmer, 2001, *Nat Biotechnol* 19:423-428), family shuffling (Crameri et al., 1998, *Nature* 391:288-291; U.S. Pat. No. 6,376,246), RACHIT™ (Coco et al., 2001, *Nat Biotechnol* 19:354-359; PCT WO 02/06469), STEP and random priming of in vitro recombination (Zhao et al., 1998, *Nat Biotechnol* 16:258-261; Shao et al., 1998, *Nucleic Acids Res* 26:681-683), exonuclease mediated gene assembly (U.S. Pat. No. 6,352,842; U.S. Pat. No. 6,361,974), Gene Site Saturation Mutagenesis™ (U.S. Pat. No. 6,358,709), Gene Reassembly™ (U.S. Pat. No. 6,358,709), SCRATCHY (Lutz et al., 2001, *Proc Natl Acad Sci USA* 98:11248-11253), DNA fragmentation methods (Kikuchi et al., *Gene* 236:159-167), single-stranded DNA shuffling (Kikuchi et al., 2000, *Gene* 243:133-137), and AMEsystem™ directed evolution protein engineering technology (Applied Molecular Evolution) (U.S. Pat. No. 5,824,514; U.S. Pat. No. 5,817,483; U.S. Pat. No. 5,814,476; U.S. Pat. No. 5,763,192; U.S. Pat. No. 5,723,323).

The biological properties of the antibodies and Fc fusions that comprise the Fc variants of the present invention may be characterized in cell, tissue, and whole organism experiments. As is know in the art, drugs are often tested in animals, including but not limited to mice, rats, rabbits, dogs, cats, pigs, and monkeys, in order to measure a drug's efficacy for treatment against a disease or disease model, or to measure a drug's pharmacokinetics, toxicity, and other properties. Said animals may be referred to as disease models. Therapeutics are often tested in mice, including but not limited to nude mice, SCID mice, xenograft mice, and transgenic mice (including knockins and knockouts). For example, an antibody or Fc fusion of the present invention that is intended as an anti-cancer therapeutic may be tested in a mouse cancer model, for example a xenograft mouse. In this method, a tumor or tumor cell line is grafted onto or injected into a mouse, and subsequently the mouse is treated with the therapeutic to determine the ability of the antibody or Fc fusion to reduce or inhibit cancer growth. Such experimentation may provide meaningful data for determination of the potential of said antibody or Fc fusion to be used as a therapeutic. Any organism, preferably mammals, may be used for testing. For example because of their genetic similarity to humans, monkeys can be suitable therapeutic models, and thus may be used to test the efficacy, toxicity, pharmacokinetics, or other property of the antibodies and Fc fusions of the present invention. Tests of the antibodies and Fc fusions of the present invention in humans are ultimately required for approval as drugs, and thus of course these experiments are contemplated. Thus the antibodies and Fc fusions of the present invention may be tested in humans to determine their therapeutic efficacy, toxicity, pharmacokinetics, and/or other clinical properties.

EXAMPLES

Examples are provided below to illustrate the present invention. These examples are not meant to constrain the present invention to any particular application or theory of operation.

For all positions discussed in the present invention, numbering is according to the EU index as in Kabat (Kabat et al., 1991, *Sequences of Proteins of Immunological Interest*, 5th Ed., United States Public Health Service, National Institutes of Health, Bethesda). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence. FIG. 3 shows the sequential and EU index numbering schemes for the antibody alemtuzumab in order to illustrate this principal more clearly. It should also be noted that polymorphisms have been observed at a number of Fc positions, including but not limited to Kabat 270, 272, 312, 315, 356, and 358, and thus slight differences between the presented sequence and sequences in the scientific literature may exist.

Example 1

Computational Screening and Design of Fc Libraries

Computational screening calculations were carried out to design optimized Fc variants. Fc variants were computationally screened, constructed, and experimentally investigated over several computation/experimention cycles. For each successive cycle, experimental data provided feedback into the next set of computational screening calculations and library design. All computational screening calculations and library design are presented in Example 1. For each set of calculations, a table is provided that presents the results and provides relevant information and parameters.

Several different structures of Fc bound bound to the extracellular domain of FcγRs served as template structures for the computational screening calculations. Publicly available Fc/FcγR complex structures included pdb accession code 1E4K (Sondermann et al., 2000, *Nature* 406:267-273), and pdb accession codes 1IIS and 1IIX (Radaev et al., 2001, *J Biol Chem* 276:16469-16477). The extracellular regions of FcγRIIIb and FcγRIIIa are 96% identical, and therefore the use of the Fc/FcγRIIIb structure is essentially equivalent to use of FcγRIIIa. Nonetheless, for some calculations, a more precise Fc/FcγRIIIa template structure was constructed by modeling a D129G mutation in the 1IIS and 1E4K structures (referred to as D129G 1IIS and D129G 1E4K template structures). In addition, the structures for human Fc bound to the extracellular domains of human FcγRIIb, human F158 FcγRIIa, and mouse FcγRIII were modeled using standard methods, the available FcγR sequence information, the aforementioned Fc/FcγR structures, as well as structural information for unbound complexes (pdb accession code 1H9V) (Sondermann et al., 2001, *J Mol Biol* 309:737-749) (pdb accession code 1 FCG)(Maxwell et al., 1999, *Nat Struct Biol* 6:437-442), FcγRIIb (pdb accession code 2FCB)(Sondermann et al., 1999, *Embo J* 18:1095-1103), and FcγRIIIb (pdb accession code 1E4J)(Sondermann et al., 2000, *Nature* 406: 267-273).

Variable positions and amino acids to be considered at those positions were chosen by visual inspection of the aforementioned Fc/FcγR and FcγR structures, and using solvent accessibility information and sequence information. Sequence information of Fcs and FcγRs was particularly useful for determining variable positions at which substitutions may provide distinguishing affinities between activating and inhibitory receptors. Virtually all Cγ2 positions were screened computationally. The Fc structure is a homodimer of two heavy chains (labeled chains A and B in the 1IIS, 1IIX, and 1E4K structures) that each include the hinge and Cγ2-Cγ3 domains (shown in FIG. 2). Because the FcγR (labeled chain C in the 1IIS, 1IIX, and 1E4K structures) binds asymmetrically to the Fc homodimer, each chain was often considered separately in design calculations. For some calculations, Fc and/or FcγR residues proximal to variable position residues were floated, that is the amino acid conformation but not the amino acid identity was allowed to vary in a protein design calculation to allow for conformational adjustments. These are indicated below the table for each set of calculations when relevant. Considered amino acids typically belonged to either the Core, Core XM, Surface, Boundary, Boundary XM, or All 20 classifications, unless noted otherwise. These classifications are defined as follows: Core=alanine, valine, isoleucine, leucine, phenylalanine, tyrosine, tryptophan, and methionine; Core XM=alanine, valine, isoleucine, leucine, phenylalanine, tyrosine, and tryptophan; Surface=alanine, serine, threonine, aspartic acid, asparagine, glutamine, glutamic acid, arginine, lysine and histidine; Boundary=alanine, serine, threonine, aspartic acid, asparagine, glutamine, glutamic acid, arginine, lysine, histidine, valine, isoleucine, leucine, phenylalanine, tyrosine, tryptophan, and methionine; Boundary XM=Boundary=alanine, serine, threonine, aspartic acid, asparagine, glutamine, glutamic acid, arginine, lysine, histidine, valine, isoleucine, leucine, phenylalanine, tyrosine, and tryptophan; All 20=all 20 naturally occurring amino acids.

The majority of calculations followed one of two general types of computational screening methods. In one method, the conformations of amino acids at variable positions were represented as a set of backbone-independent side chain rotamers derived from the rotamer library of Dunbrack & Cohen (Dunbrack et al., 1997, *Protein Sci* 6:1661-1681). The energies of all possible combinations of the considered amino acids at the chosen variable positions were calculated using a force field containing terms describing van der Waals, solvation, electrostatic, and hydrogen bond interactions, and the optimal (ground state) sequence was determined using a Dead End Elimination (DEE) algorithm. As will be appreciated by those in the art, the predicted lowest energy sequence is not necessarily the true lowest energy sequence because of errors primarily in the scoring function, coupled with the fact that subtle conformational differences in proteins can result in dramatic differences in stability. However, the predicted ground state sequence is likely to be close to the true ground state, and thus additional favorable diversity can be explored by evaluating the energy of sequences that are close in sequence space and energy around the predicted ground state. To accomplish this, as well as to generate a diversity of sequences for a library, a Monte Carlo (MC) algorithm was used to evaluate the energies of 1000 similar sequences around the predicted ground state. The number of sequences out of the 1000 sequence set that contain that amino acid at that variable position is referred to as the occupancy for that substitution, and this value may reflect how favorable that substitution is. This computational screening method is substantially similar to Protein Design Automation® (PDA®) technology, as described in U.S. Pat. No. 6,188,965; U.S. Pat. No. 6,269,312; U.S. Pat. No. 6,403,312; U.S. Ser. No. 09/782, 004; U.S. Ser. No. 09/927,790; U.S. Ser. No. 10/218,102; PCT WO 98/07254; PCT WO 01/40091; and PCT WO 02/25588, and for ease of description, is referred to as PDA® technology throughout the examples. Tables that present the results of these calculations provide for each variable position on the designated chain (column 1) the amino acids considered at each variable position (column 2), the WT Fc amino acid identity at each variable position (column 3), the amino acid identity at each variable position in the DEE ground state sequence (column 4), and the set of amino acids and corresponding occupancy that are observed in the Monte Carlo output (column 5). For example in the first row of Table 1 below, when position 328 was varied using boundary amino acids as the set of variable residues for that position, L occurred 330 times in the top 1000 sequence, M occurred 302 times, etc.

Other calculations utilized a genetic algorithm (GA) to screen for low energy sequences, with energies being calculated during each round of "evolution" for those sequences being sampled. The conformations of amino acids at variable and floated positions were represented as a set of side chain rotamers derived from a backbone-independent rotamer library using a flexible rotamer model (Mendes et al., 1999, *Proteins* 37:530-543). Energies were calculated using a force field containing terms describing van der Waals, solvation, electrostatic, and hydrogen bond interactions. This calculation generated a list of 300 sequences which are predicted to be low in energy. To facilitate analysis of the results and library generation, the 300 output sequences were clustered computationally into 10 groups of similar sequences using a nearest neighbor single linkage hierarchical clustering algorithm to assign sequences to related groups based on similarity scores (Diamond, 1995, *Acta Cryst D* 51:127-135). That is, all sequences within a group are most similar to all other sequences within the same group and less similar to sequences in other groups. The lowest energy sequence from each of these ten clusters are used as a representative of each group, and are presented as results. This computational screening method is substantially similar to Sequence Prediction Algorithm™ (SPA™) technology, as described in (Raha et al., 2000, *Protein Sci* 9:1106-1119); U.S. Ser. No. 09/877,695; and U.S. Ser. No. 10/071,859, and for ease of description, is referred to as SPA™ technology throughout the examples. Tables that present the results of these calculations provide for each variable position on the designated chain (column 1) the amino acids considered at each variable position (column 2), the WT Fc amino acid identity at each variable position (column 3), and the amino acid identity at the variable positions for the lowest energy sequence from each cluster group (columns 4-13).

Computational screening was applied to design energetically favorable interactions at the Fc/FcγR interface at groups of variable positions that mediate or potentially mediate binding with FcγR. Because the binding interface involves a large number of Fc residues on the two different chains, and because FcγRs bind asymmetrically to Fc, residues were grouped in different sets of interacting variable positions, and designed in separate sets of calculations. In many cases these sets were chosen as groups of residues that were deemed to be coupled, that is the energy of one or more residues is dependent on the identity of one or more other residues. Various template structures were used, and in many cases calculations explored substitutions on both chains. For many of the variable position sets, calculations were carried out using both the PDA® and SPA™ technology computational screening methods described. The results of these calculations and relevant are presented in Tables 1-30 below. Relevant parameters and information are presented below each table, including the computational screening method used, the template structure used, whether or not that structure had carbohydrate atoms, and any residues that may have been floated. For example, Table 2 presents results from a PDA® calculation in which residues 120, 132, and 134 on chain C (the FcγRIIIb receptor) were floated.

Included within the compositions of the invention are antibodies that have any of the listed amino acid residues in the listed positions, either alone or in any combination (note preferred combinations are listed in the claims, the summary and the figures). One preferred combination is the listed amino acid residues in the listed positions in a ground state (sometimes referred to herein as the "global solution", as distinguished from the wild-type). In addition, combinations between SPA™ proteins, both within tables and between tables, are also included. It should be noted that residues not listed in a given table are implied to have not been varied, and thus remain wild-type. For example, in the SPA™ calculation results presented in Table 4, column 4 (representing cluster 1) indicates a protein with the six listed amino acids at the six listed positions (e.g. column 4 is a single protein with a wild-type sequence except for 239E, 265G, 267S, 269Y, 270T and 299S). Thus, each of these individual proteins are included within the invention. Alternatively, residue positions and particular amino acids at those residue positions may be combined between columns within a table, or between tables. Furthermore, it should be noted that although each table indicates the presence or absence of carbohydrate, the presence or absence of said atoms in the computational screening calculation is not meant to imply that Fc variants designed by such calculations should be applicable to only aglycosylated or glycosylated Fc. Thus although the calculations in Table 1 were run without carbohydrate atoms present in the template structure, the resulting predicted substitutions may be favorable in a glycosylated or aglycosylated antibody or Fc fusion.

TABLE 1

| Position | Considered Amino Acids | WT | Ground State | Sequences Around Ground State |
|---|---|---|---|---|
| 328 A | Boundary | L | L | L: 330 M: 302 E: 111 K: 62 A: 45 Q: 39 D: 36 S: 30 T: 28 N: 10 R: 7 |
| 332 A | Surface | I | R | R: 247 K: 209 Q: 130 H: 95 E: 92 T: 59 D: 51 N: 51 S: 42 A: 24 |
| 328 B | Boundary | L | L | L: 321 M: 237 T: 166 K: 73 R: 72 S: 55 Q: 20 D: 17 E: 13 A: 12 V: 10 N: 4 |
| 332 B | Surface | I | E | E: 269 Q: 180 R: 145 K: 111 D: 97 T: 78 N: 65 S: 28 A: 14 H: 13 |

PDA ® technology, 1IIS template structure; −carbohydrate

TABLE 2

| Position | Considered Amino Acids | WT | Ground State | Sequences Around Ground State |
|---|---|---|---|---|
| 239 A | Surface | S | K | E: 349 D: 203 K: 196 A: 95 Q: 83 S: 63 N: 10 R: 1 |
| 265 A | Boundary XM | D | D | D: 616 N: 113 L: 110 E: 104 S: 25 A: 23 Q: 9 |
| 299 A | Boundary XM | T | I | I: 669 H: 196 V: 135 |
| 327 A | Boundary XM | A | S | A: 518 S: 389 N: 67 D: 26 |
| 265 B | Boundary XM | D | Q | Q: 314 R: 247 N: 118 I: 115 A: 63 E: 55 D: 34 S: 22 K: 21 V: 11 |

PDA ® technology; 1IIS template structure; +carbohydrate; floated 120 C, 132 C, 134 C

TABLE 3

| Position | Considered Amino Acids | WT | Ground State | Sequences Around Ground State |
|---|---|---|---|---|
| 239 A | Surface | S | E | E: 872 Q: 69 D: 39 K: 16 A: 4 |
| 265 A | Boundary XM | D | Y | Y: 693 H: 111 E: 69 D: 62 F: 29 K: 19 R: 14 W: 2 Q: 1 |
| 267 A | Boundary XM | S | S | S: 991 A: 9 |
| 269 A | Core XM | E | F | F: 938 E: 59 Y: 3 |
| 270 A | Surface | D | E | E: 267 T: 218 K: 186 D: 89 Q: 88 R: 46 S: 34 N: 29 H: 23 A: 20 |
| 299 A | Boundary XM | T | H | H: 486 T: 245 K: 130 E: 40 S: 39 D: 27 Q: 27 A: 4 N: 2 |

PDA ® technology; 1IIS template structure; −carbohydrate; floated 120 C, 122 C, 132 C, 133 C, 134 C

TABLE 4

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | Surface | S | E | Q | Q | Q | E | E | E | Q | E | E |
| 265 A | All 20 | D | G | G | G | G | G | G | G | G | G |
| 267 A | All 20 | S | S | S | S | S | S | S | S | S | S | S |
| 269 A | Core | E | Y | Y | A | A | V | Y | A | A | A | A |
| 270 A | Surface | D | T | S | A | S | T | T | T | A | A | A |
| 299 A | All 20 | T | S | S | S | S | S | S | S | S | S | S |

SPA ™ technology; 1IIS template structure; +carbohydrate; floated 120 C, 122 C, 132 C, 133 C, 134 C

TABLE 5

| Position | Considered Amino Acids | WT | Ground State | Sequences Around Ground State |
|---|---|---|---|---|
| 235 A | Boundary XM | L | T | T: 195 V: 131 L: 112 W: 107 K: 85 F: 66 Y: 56 E: 52 Q: 38 S: 37 I: 34 R: 29 H: 26 N: 23 D: 9 |
| 296 A | Surface | Y | N | N: 322 D: 181 R: 172 K: 76 Y: 70 Q: 59 E: 48 S: 40 H: 20 T: 11 A: 1 |
| 298 A | Surface | S | T | T: 370 R: 343 K: 193 A: 55 S: 39 |
| 235 B | Boundary XM | L | L | L: 922 I: 78 |

PDA ® technology; 1IIS template structure; −carbohydrate; floated 119 C, 128 C, 157 C

TABLE 6

| Position | Considered Amino Acids | WT | 1 | 2 | 3 | 4 | 5 | 6 | 7 | 8 | 9 | 10 |
|---|---|---|---|---|---|---|---|---|---|---|---|---|
| 235 A | All 20 | L | S | S | P | S | S | S | S | S | S | S |
| 296 A | Surface | Y | Q | Q | Q | E | E | Q | E | Q | Q | N |
| 298 A | Surface | S | S | K | K | K | K | S | S | S | K | S |
| 235 B | All 20 | L | K | K | K | L | L | L | L | L | L | K |

SPA ™ technology; 1IIS template structure; +carbohydrate; floated 119 C, 128 C, 157 C

TABLE 7

| Position | Considered Amino Acids | WT | Ground State | Sequences Around Ground State |
|---|---|---|---|---|
| 239 B | Surface | S | E | K: 402 E: 282 H: 116 T: 67 R: 47 Q: 39 D: 26 A: 11 S: 7 N: 3 |
| 265 B | Boundary XM | D | W | Y: 341 W: 283 I: 236 V: 77 F: 36 H: 9 T: 7 E: 4 K: 4 A: 2 D: 1 |
| 327 B | Boundary XM | A | R | R: 838 K: 86 H: 35 E: 12 T: 10 Q: 7 A: 6 D: 3 N: 3 |
| 328 B | Core XM | L | L | L: 1000 |
| 329 B | Core XM | P | P | P: 801 A: 199 |
| 330 B | Core XM | A | Y | Y: 918 F: 42 L: 22 A: 18 |
| 332 B | Surface | I | I | I: 792 E: 202 Q: 5 K: 1 |

PDA ® technology; 1IIS template structure; −carbohydrate; floated 88 C, 90 C, 113 C, 114 C, 116 C, 160 C, 161 C

TABLE 8

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | Surface | S | D | T | E | E | E | E | E | E | E | E |
| 265 B | All 20 | D | G | G | K | G | K | G | G | K | G | G |
| 327 B | All 20 | A | K | M | L | L | N | L | K | L | L | L |
| 328 B | Core | L | M | M | M | L | A | M | L | M | L | L |
| 329 B | Core | P | P | P | P | P | P | P | P | P | P | P |
| 330 B | Core | A | L | A | A | A | A | A | A | A | A | A |
| 332 B | Surface | I | I | Q | I | Q | Q | E | D | I | I | I |

SPA ™ technology; 1IIS template structure; +carbohydrate; floated 88 C, 90 C, 113 C, 114 C, 116 C, 160 C, 161 C

TABLE 9

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | Surface | S | Q | Q | Q | E | Q | E | Q | E | Q | Q |
| 265 A | All 20 | D | G | G | G | G | G | G | G | G | G | G |
| 299 A | All 20 | T | S | S | A | S | S | S | S | S | S | S |
| 327 A | All 20 | A | A | S | S | S | S | S | S | S | A | S |
| 265 B | All 20 | D | N | G | G | G | G | G | G | G | G | G |

SPA ™ technology; 1IIS template structure; −carbohydrate; floated 120 C, 132 C, 134 C

TABLE 10

| Position | Considered Amino Acids | WT | Ground State | Sequences Around Ground State |
|---|---|---|---|---|
| 234 A | Boundary XM | L | K | Y: 401 L: 260 F: 151 I: 82 K: 63 H: 17 Q: 11 W: 7 R: 3 T: 2 E: 2 V: 1 |
| 235 A | Boundary XM | L | L | W: 777 L: 200 K: 12 Y: 5 I: 3 F: 2 V: 1 |
| 234 B | Boundary XM | L | W | W: 427 Y: 203 L: 143 F: 74 I: 59 E: 32 K: 23 V: 14 D: 10 T: 7 H: 4 R: 4 |
| 235 B | Boundary XM | L | W | W: 380 Y: 380 F: 135 K: 38 L: 26 E: 15 Q: 12 H: 8 R: 4 T: 2 |

PDA ® technology; D129G 1E4K template structure; −carbohydrate; floated 113 C, 116 C, 132 C, 155 C, 157 C

TABLE 11

| Position | Considered Amino Acids | WT | 1 | 2 | 3 | 4 | 5 | 6 | 7 | 8 | 9 | 10 |
|---|---|---|---|---|---|---|---|---|---|---|---|---|
| 234 A | All 20 | L | G | G | G | G | G | G | G | G | G | G |
| 235 A | All 20 | L | T | L | L | L | L | L | L | L | T | L |
| 234 B | All 20 | L | G | G | G | G | G | G | G | G | G | G |
| 235 B | All 20 | L | S | A | S | A | A | S | S | S | A | A |

SPA ™ technology; D129G 1E4K template structure; +carbohydrate; floated 113 C, 116 C, 132 C, 155 C, 157 C

TABLE 12

| Position | Considered Amino Acids | WT | Ground State | Sequences Around Ground State |
|---|---|---|---|---|
| 239 A | Boundary XM | S | E | E: 235 S: 122 D: 94 Q: 93 A: 74 K: 70 L: 67 T: 63 N: 57 R: 51 I: 29 V: 18 W: 15 H: 12 |
| 328 A | Boundary XM | L | L | L: 688 E: 121 K: 43 Q: 41 A: 33 D: 26 S: 14 T: 14 N: 12 R: 8 |
| 332 A | Boundary XM | I | W | I: 155 W: 95 L: 82 K: 79 E: 74 Q: 69 H: 67 V: 63 R: 57 T: 57 D: 45 S: 43 N: 42 A: 35 F: 19 Y: 18 |

PDA ® technology; D129G 1IIS template structure; −carbohydrate; floated 120 C

TABLE 13

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | L | E | E | Q | E | E | K | K | K | K |
| 328 A | All 20 | L | L | Q | L | Q | K | L | L | Q | K | L |
| 332 A | All 20 | I | K | K | L | Q | A | K | L | Q | A | Q |

SPA ™ technology; D129G 1IIS template structure; +carbohydrate; floated 120 C

TABLE 14

| Position | Considered Amino Acids | WT | Ground State | Sequences Around Ground State |
|---|---|---|---|---|
| 239 B | Boundary XM | S | I | R: 195 I: 169 L: 126 V: 91 K: 89 E: 61 H: 52 T: 50 Q: 42 N: 35 S: 34 D: 30 A: 26 |
| 328 B | Boundary XM | L | L | L: 671 T: 165 K: 40 S: 38 E: 28 R: 17 Q: 17 V: 11 A: 8 D: 5 |
| 332 B | Boundary XM | I | I | I: 387 E: 157 L: 151 V: 78 Q: 63 K: 50 R: 33 T: 29 D: 25 A: 12 N: 8 S: 6 W: 1 |

PDA ® technology; D129G 1IIS template structure; −carbohydrate; floated 90 C, 160 C, 161 C

TABLE 15

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | T | L | L | L | L | L | L | L | L | L |
| 328 B | All 20 | L | M | R | M | D | T | M | L | Q | D | L |
| 332 B | All 20 | I | I | D | Q | Q | Q | L | L | T | Q | L |

SPA ™ technology; D129G 1IIS template structure; +carbohydrate; floated 90 C, 160 C, 161 C

TABLE 16

| Position | Considered Amino Acids | WT | Ground State | Sequences Around Ground State |
|---|---|---|---|---|
| 239 B | Boundary XM | S | T | T: 164 S: 159 L: 156 E: 86 W: 76 K: 71 D: 65 A: 52 R: 43 H: 38 Q: 38 N: 31 I: 14 V: 7 |
| 328 B | Boundary XM | L | L | L: 556 E: 114 T: 84 K: 80 S: 69 Q: 36 A: 31 D: 15 R: 11 N: 4 |
| 332 B | Boundary XM | I | W | I: 188 W: 177 E: 97 L: 94 T: 59 Q: 57 V: 54 K: 52 F: 51 D: 34 H: 33 S: 27 R: 26 N: 18 A: 17 Y: 16 |

PDA ® technology; D129G 1E4K template structure; −carbohydrate; floated 117 C

TABLE 17

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | P | S | P | E | L | L | L | L | L | L |
| 328 B | All 20 | L | K | K | K | K | K | L | K | K | K | L |
| 332 B | All 20 | I | S | S | E | L | L | E | L | L | L | L |

SPA ™ technology; D129G 1E4K template structure; +carbohydrate; floated 117 C

TABLE 18

| Position | Considered Amino Acids | WT | Ground State | Sequences Around Ground State |
|---|---|---|---|---|
| 239 A | Boundary XM | S | L | K: 196 L: 171 I: 146 E: 88 V: 76 R: 75 T: 50 H: 45 D: 43 Q: 39 S: 30 N: 22 A: 19 |
| 328 A | Boundary XM | L | W | L: 517 F: 230 W: 164 H: 40 K: 29 E: 11 R: 5 T: 4 |
| 332 A | Boundary XM | I | E | I: 283 L: 217 E: 178 Q: 81 V: 64 D: 47 T: 35 K: 27 W: 18 R: 12 A: 10 Y: 7 N: 7 F: 6 S: 5 H: 3 |

PDA ® technology; D129G 1E4K template structure; −carbohydrate; floated 87 C, 157 C, 158 C

TABLE 19

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | F | Q | E | T | P | P | T | P | P | P |
| 328 A | All 20 | L | K | R | R | K | K | M | R | K | M | R |
| 332 A | All 20 | I | L | L | I | I | E | I | E | E | I | I |

SPA ™ technology; D129G 1E4K template structure; +carbohydrate atoms; floated 87 C, 157 C, 158 C

TABLE 20

| Position | Considered Amino Acids | WT | Ground State | Sequences Around Ground State |
|---|---|---|---|---|
| 240 A | Core + Thr | V | V | V: 698 M: 162 T: 140 |
| 263 A | Core + Thr | V | V | V: 966 T: 34 |
| 266 A | Core + Thr | V | V | V: 983 T: 17 |
| 325 A | Boundary | N | N | N: 943 T: 40 A: 17 |
| 328 A | Boundary | L | L | L: 610 M: 363 K: 27 |
| 332 A | Glu | I | E | E: 1000 |

PDA ® technology; D129G 1IIS template structure; −carbohydrate; floated 273 A, 275 A, 302 A, 323 A, 134 C

TABLE 21

| Position | Considered Amino Acids | WT | 1 | 2 | 3 | 4 | 5 | 6 | 7 | 8 | 9 | 10 |
|---|---|---|---|---|---|---|---|---|---|---|---|---|
| 240 A | All 20 | V | V | A | V | V | V | V | V | V | V | V |
| 263 A | All 20 | V | V | V | V | V | V | V | V | V | V | V |
| 266 A | All 20 | V | I | V | I | I | T | V | V | V | V | I |
| 325 A | All 20 | N | A | N | N | N | Q | T | T | Q | N | T |
| 328 A | All 20 | L | K | K | L | K | L | K | L | L | L | L |
| 332 A | Glu | I | D | D | D | D | D | D | D | D | D | D |

SPA ™ technology; D129G 1IIS template structure; +carbohydrate; floated 273 A, 275 A, 302 A, 323 A, 134 C

TABLE 22

| Position | Considered Amino Acids | WT | Ground State | Sequences Around Ground State |
|---|---|---|---|---|
| 240 B | Core + Thr | V | V | V: 713 T: 287 |
| 263 B | Core + Thr | V | V | V: 992 T: 8 |
| 266 B | Core + Thr | V | V | V: 976 T: 24 |
| 325 B | Boundary | N | N | N: 453 T: 296 A: 116 D: 96 S: 30 V: 9 |
| 328 B | Boundary | L | L | L: 623 M: 194 T: 100 R: 72 K: 11 |
| 332 B | Glu | I | E | E: 1000 |

PDA ® technology; D129G 1IIS template structure; –carbohydrate; floated 273 B, 275 B, 302 B, 323 B, 161 C

TABLE 23

| Position | Considered Amino Acids | WT | 1 | 2 | 3 | 4 | 5 | 6 | 7 | 8 | 9 | 10 |
|---|---|---|---|---|---|---|---|---|---|---|---|---|
| 240 B | All 20 | V | A | T | A | T | T | A | A | T | T | T |
| 263 B | All 20 | V | V | A | A | T | T | V | V | T | A | T |
| 266 B | All 20 | V | V | V | V | V | V | V | V | V | I | V |
| 325 B | All 20 | N | N | K | N | K | K | N | N | N | N | N |
| 328 B | All 20 | L | R | L | L | L | L | L | L | L | L | L |
| 332 A | Glu | I | D | D | D | D | D | D | D | D | D | D |

SPA ™ technology; D129G 1IIS template structure; +carbohydrate; floated 273 B, 275 B, 302 B, 323 B, 161 C

TABLE 24

| Position | Considered Amino Acids | WT | Ground State | Sequences Around Ground State |
|---|---|---|---|---|
| 240 B | Core + Thr | V | M | V: 715 M: 271 T: 12 I: 2 |
| 263 B | Core + Thr | V | V | V: 992 T: 8 |
| 266 B | Core + Thr | V | V | V: 996 T: 4 |
| 325 B | Boundary | N | N | N: 651 T: 232 D: 64 A: 53 |
| 328 B | Boundary | L | M | M: 556 L: 407 K: 37 |
| 332 B | Glu | I | E | E: 1000 |

PDA ® technology; D129G 1E4K template structure; –carbohydrate; floated 273 B, 275 B, 302 B, 323 B, 131 C

TABLE 25

| Position | Considered Amino Acids | WT | 1 | 2 | 3 | 4 | 5 | 6 | 7 | 8 | 9 | 10 |
|---|---|---|---|---|---|---|---|---|---|---|---|---|
| 240 B | All 20 | V | T | A | T | A | A | A | T | A | A |
| 263 B | All 20 | V | T | W | T | T | A | T | T | T | L | L |
| 266 B | All 20 | V | L | A | T | T | V | L | T | T | L | V |
| 325 B | All 20 | N | A | N | A | A | N | A | A | A | A | A |
| 328 B | All 20 | L | L | K | L | L | L | L | L | L | L | L |
| 332 A | Glu | I | D | D | D | D | D | D | D | D | D | D |

SPA ™ technology; D129G 1E4K template structure; +carbohydrate; floated 273 B, 275 B, 302 B, 323 B, 131 C

TABLE 26

| Position | Considered Amino Acids | WT | Ground State | Sequences Around Ground State |
|---|---|---|---|---|
| 240 A | Core + Thr | V | V | V: 876 T: 109 M: 15 |
| 263 A | Core + Thr | V | V | V: 913 T: 87 |
| 266 A | Core + Thr | V | V | V: 969 T: 31 |
| 325 A | Boundary | N | V | V: 491 N: 236 T: 187 A: 35 D: 32 S: 19 |

TABLE 26-continued

| Position | Considered Amino Acids | WT | Ground State | Sequences Around Ground State |
|---|---|---|---|---|
| 328 A | Boundary | L | L | L: 321 W: 290 M: 271 F: 49 K: 46 R: 23 |
| 332 A | Glu | I | E | E: 1000 |

PDA ® technology; D129G 1E4K template structure; –carbohydrate; floated 273 A, 275 A, 302 A, 323 A, 158 C

TABLE 27

| Position | Considered Amino Acids | WT | 1 | 2 | 3 | 4 | 5 | 6 | 7 | 8 | 9 | 10 |
|---|---|---|---|---|---|---|---|---|---|---|---|---|
| 240 A | All 20 | V | A | T | A | A | T | T | A | A | A | T |
| 263 A | All 20 | V | T | T | V | V | T | V | L | L | V | T |
| 266 A | All 20 | V | V | V | V | V | V | V | V | V | V | V |
| 325 A | All 20 | N | Q | N | Q | Q | Q | Q | Q | Q | N | N |
| 328 A | All 20 | L | K | M | K | K | K | K | K | K | K | K |
| 332 A | Glu | I | D | D | D | D | D | D | D | D | D | D |

SPA ™ technology; D129G 1E4K template structure; +carbohydrate; floated 273 A, 275 A, 302 A, 323 A, 158 C Computational screening calculations were aimed at designing Fc variants to optimize the conformation of the N297 carbohydrate and the Cγ2 domain. By exploring energetically favorable substitutions at positions that interact with carbohydrate, variants can be engineered that sample new, potentially favorable carbohydrate conformations. Fc residues F241, F243, V262, and V264 mediate the Fc/carbohydrate interaction and thus are target positions. The results of these design calculations are presented in Table 28.

TABLE 28

| Position | Considered Amino Acids | WT | Ground State | Sequences Around Ground State |
|---|---|---|---|---|
| 241 A | Core | F | Y | Y: 172 M: 162 L: 144 F: 140 W: 110 I: 97 A: 91 V: 84 |
| 243 A | Core | F | Y | Y: 211 L: 204 W: 199 F: 160 M: 141 A: 85 |
| 262 A | Core | V | M | M: 302 I: 253 V: 243 A: 202 |
| 264 A | Core | V | F | I: 159 M: 152 V: 142 L: 140 W: 136 F: 120 Y: 104 A: 47 |

PDA ® technology, 1IIS template structure; –carbohydrate

Computational screening calculations were aimed at designing Fc variants to optimize the angle between the Cγ3 and Cγ2 domains. Residues P244, P245, P247, and W313, which reside at the Cγ2/Cγ3 interface, appear to play a key role in determining the Cγ2-Cγ3 angle and the flexibility of the domains relative to one another. By exploring energetically favorable substitutions at these positions, variants can be designed that sample new, potentially favorable angles and levels of flexibility. The results of these design calculations are presented in Table 29.

TABLE 29

| Position | Considered Amino Acids | WT | Ground State | Sequences Around Ground State |
|---|---|---|---|---|
| 244 A | Boundary | P | H | K: 164 H: 152 R: 110 M: 100 S: 92 N: 57 A: 54 D: 50 Q: 49 T: 46 E: 37 V: 30 L: 27 W: 23 F: 9 |
| 245 A | Boundary | P | A | A: 491 S: 378 N: 131 |
| 247 A | Boundary | P | V | V: 156 T: 125 K: 101 E: 87 Q: 79 R: 78 S: 76 A: 72 D: 72 H: 60 M: 47 N: 47 |

TABLE 29-continued

| Position | Considered Amino Acids | WT | Ground State | Sequences Around Ground State |
|---|---|---|---|---|
| 313 A | Boundary | W | W | W: 359 F: 255 Y: 128 M: 114 H: 48 K: 29 T: 24 A: 11 E: 10 V: 10 S: 9 Q: 3 |

PDA ® technology; 1IIS template structure; –carbohydrate

In addition to the above calculations using PDA® and SPA™ computational screening methods, additional calculations using solely an electrostatic potential were used to computationally screen Fc variants. Calculations with Coulomb's law and Debye-Huckel scaling highlighted a number of positions in the Fc for which amino acid substitutions would favorably affect binding to one or more FcγRs, including positions for which replacement of a neutral amino acid with a negatively charged amino acid may enhance binding to FcγRIIIa, and for which replacement of a positively charged amino acid with a neutral or negatively charged amino acid may enhance binding to FcγRIIIa. These results are presented in Table 30.

TABLE 30

| Replacement of a + residue with a – residue | Replacement of a neutral residue with a – residue |
|---|---|
| H268 | S239 |
| K326 | Y296 |
| K334 | A327 |
|  | I332 |

Coulomb's law and Debye-Huckel scaling; 1IIS template structure; +carbohydrate

Computational screening calculations were carried out to optimize aglycosylated Fc, that is to optimize Fc structure, stability, solubility, and Fc/FcγR affinity in the absence of the N297 carbohydrate. Design calculations were aimed at designing favorable substitutions in the context of the aglycosylated Fc template structure at residue 297, residues proximal to it, residues at the Fc/FcγR interface, and residues at the Fc/carbohydrate interface. Variable positions were grouped in different sets of interacting variable positions and designed in separate sets of calculations, and various template structures were used. For many of the variable position sets, calculations were carried out using both the PDA® and SPA™ computational screening methods. The results of these calculations and relevant information are presented in Tables 31-53 below.

TABLE 31

| Position | Considered Amino Acids | WT | Ground State | Sequences Around Ground State |
|---|---|---|---|---|
| 265 A | Boundary XM | D | Y | Y: 531 F: 226 W: 105 H: 92 K: 21 D: 16 E: 6 T: 3 |
| 297 A | Boundary XM | N | D | A: 235 S: 229 D: 166 E: 114 N: 92 Y: 57 F: 55 Q: 25 H: 10 T: 7 K: 6 L: 3 R: 1 |
| 299 A | Boundary XM | T | L | L: 482 Y: 186 F: 131 T: 55 S: 51 K: 31 H: 22 A: 18 E: 14 Q: 10 |
| 297 B | Boundary XM | N | I | I: 299 K: 147 V: 85 R: 82 W: 71 N: 65 D: 35 E: 35 Q: 34 S: 32 L: 31 H: 30 T: 28 A: 26 |

PDA ® technology; 1IIS template structure; –carbohydrate; floated 122 C, 129 C, 132 C, 155 C

TABLE 32

| Position | Considered Amino Acids | WT | 1 | 2 | 3 | 4 | 5 | 6 | 7 | 8 | 9 | 10 |
|---|---|---|---|---|---|---|---|---|---|---|---|---|
| 265 A | All 20 | D | G | G | G | G | G | G | G | G | G |
| 297 A | All 20 | N | A | T | A | E | K | K | A | N | N |
| 299 A | All 20 | T | S | K | S | K | F | F | F | F | S |
| 297 B | All 20 | N | K | K | K | K | K | K | K | K | K |

SPA ™ technology; 1IIS template structure; –carbohydrate; floated 122 C, 129 C, 132 C, 155 C

TABLE 33

| Position | Considered Amino Acids | WT | Ground State | Sequences Around Ground State |
|---|---|---|---|---|
| 239 A | Surface | S | E | E: 928 Q: 65 D: 7 |
| 265 A | Boundary XM | D | W | W: 709 Y: 248 F: 43 |
| 296 A | Surface | Y | H | H: 449 Y: 146 E: 137 D: 89 K: 64 N: 32 T: 30 R: 25 Q: 23 S: 5 |
| 297 A | Surface | N | E | E: 471 H: 189 D: 102 T: 97 K: 96 R: 22 Q: 15 S: 8 |
| 298 A | Boundary XM | S | R | R: 353 T: 275 K: 269 A: 56 S: 38 E: 5 Q: 2 H: 2 |
| 299 A | Boundary XM | T | F | Y: 398 F: 366 L: 217 H: 15 K: 4 |

PDA ® technology; D129G 1IIS template structure; –carbohydrate; floated 120 C, 122 C, 128 C, 132 C, 155 C

TABLE 34

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | E | Q | Q | E | Q | Q | Q | Q | Q |
| 265 A | All 20 | D | G | G | G | G | G | G | G | Q | G |
| 296 A | All 20 | Y | D | Q | N | Q | N | N | N | Q | N |
| 297 A | All 20 | N | A | A | N | A | D | D | E | N | E |
| 298 A | All 20 | S | K | K | K | S | K | K | K | S | K |
| 299 A | All 20 | T | S | Y | F | S | Y | F | K | F | S | K |

SPA ™ technology; D129G 1IIS template structure; –carbohydrate; floated 120 C, 122 C, 128 C, 132 C, 155 C

TABLE 35

| Position | Considered Amino Acids | WT | Ground State | Sequences Around Ground State |
|---|---|---|---|---|
| 239 B | Surface | S | E | E: 417 T: 122 D: 117 Q: 94 R: 84 S: 63 K: 47 H: 29 N: 19 A: 8 |
| 265 B | Boundary XM | D | W | W: 865 Y: 79 F: 55 K: 1 |
| 296 B | Surface | Y | Y | Y: 549 H: 97 D: 80 S: 75 N: 48 E: 45 K: 32 R: 30 Q: 28 A: 16 |
| 297 B | Surface | N | R | R: 265 H: 224 E: 157 K: 154 Q: 75 D: 47 T: 34 N: 24 S: 13 A: 7 |
| 298 B | Boundary XM | S | V | V: 966 D: 10 T: 8 A: 8 N: 4 S: 4 |
| 299 B | Boundary XM | T | Y | Y: 667 F: 330 H: 3 |

PDA ® technology; D129G 1E4K template structure; –carbohydrate; floated 117 C, 119 C, 125 C, 129 C, 152 C

TABLE 36

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | S | R | E | K | S | S | E | E | E | K |
| 265 B | All 20 | D | A | D | K | Y | A | A | F | F | K | Y |
| 296 B | All 20 | Y | A | A | A | A | A | A | A | A | A | A |
| 297 B | All 20 | N | T | S | T | T | E | E | E | S | E | E |
| 298 B | All 20 | S | G | G | G | G | G | G | G | G | G | G |
| 299 B | All 20 | T | L | F | E | E | Y | F | Y | F | Y | Y |

SPA ™ technology; D129G 1E4K template structure; –carbohydrate; floated 117 C, 119 C, 125 C, 129 C, 152 C

TABLE 37

| Position | Considered Amino Acids | WT | Ground State | Sequences Around Ground State |
|---|---|---|---|---|
| 239 A | Surface | S | E | E: 868 Q: 92 D: 38 K: 1 N: 1 |
| 265 A | Boundary XM | D | W | W: 575 Y: 343 F: 66 H: 15 K: 1 |
| 296 A | Surface | Y | H | H: 489 Y: 103 R: 98 K: 97 Q: 64 D: 63 T: 41 N: 38 E: 7 |
| 297 A | Asp | N | D | D: 1000 |
| 298 A | Boundary XM | S | R | R: 340 K: 262 T: 255 A: 59 S: 57 E: 11 Q: 10 H: 6 |
| 299 A | Boundary XM | T | F | Y: 375 F: 323 L: 260 H: 24 K: 18 |

PDA ® technology; D129G 1IIS template structure; –carbohydrate; floated 120 C, 122 C, 128 C, 132 C, 155 C

TABLE 38

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | E | Q | E | E | E | E | E | E | Q | E |
| 265 A | All 20 | D | G | G | G | G | G | G | G | G | G | G |
| 296 A | All 20 | Y | E | N | Q | E | N | Q | Q | Q | Q | N |
| 297 A | Asp | N | D | D | D | D | D | D | D | D | D | D |
| 298 A | All 20 | S | K | S | K | S | K | K | K | S | K | K |
| 299 A | All 20 | T | S | K | Y | S | F | F | F | F | F | K |

SPA ™ technology; D129G 1IIS template structure; –carbohydrate; floated 120 C, 122 C, 128 C, 132 C, 155 C

TABLE 39

| Position | Considered Amino Acids | WT | Ground State | Sequences Around Ground State |
|---|---|---|---|---|
| 239 B | Surface | S | E | E: 318 Q: 123 T: 109 D: 108 R: 93 S: 89 K: 69 N: 40 H: 38 A: 13 |
| 265 B | Boundary XM | D | W | W: 745 Y: 158 F: 85 K: 9 E: 1 R: 1 H: 1 |
| 296 B | Surface | Y | Y | Y: 390 H: 127 S: 83 R: 81 K: 78 N: 65 D: 55 E: 49 Q: 44 A: 26 T: 2 |
| 297 B | Asp | N | D | D: 1000 |
| 298 B | Boundary XM | S | V | V: 890 T: 35 A: 29 D: 19 S: 16 N: 10 E: 1 |
| 299 B | Boundary XM | T | Y | Y: 627 F: 363 H: 10 |

PDA ® technology; D129G 1E4K template structure; –carbohydrate; floated 117 C, 119 C, 125 C, 129 C, 152 C

TABLE 40

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | K | E | E | Q | E | K | Q | E | K | Q |
| 265 B | All 20 | D | F | K | K | A | K | Y | W | K | L | F |
| 296 B | All 20 | Y | A | A | A | A | A | A | A | A | A | A |
| 297 B | Asp | N | D | D | D | D | D | D | D | D | D | D |
| 298 B | All 20 | S | G | G | G | G | G | G | G | G | G | G |
| 299 B | All 20 | T | Y | Y | Y | Y | Y | Y | F | F | Y | Y |

SPA ™ technology; D129G 1E4K template structure; –carbohydrate; floated 117 C, 119 C, 125 C, 129 C, 152 C

TABLE 41

| Position | Considered Amino Acids | WT | Ground State | Sequences Around Ground State |
|---|---|---|---|---|
| 239 A | Boundary XM | S | E | E: 312 L: 148 D: 102 Q: 98 K: 64 I: 61 S: 57 A: 44 T: 39 N: 29 R: 23 V: 18 W: 5 |
| 265 A | Boundary XM | D | W | W: 363 Y: 352 F: 139 H: 77 K: 39 R: 14 D: 11 E: 4 Q: 1 |
| 297 A | Asp | N | D | D: 1000 |
| 299 A | Boundary XM | T | Y | Y: 309 F: 224 L: 212 H: 96 K: 92 E: 28 Q: 20 R: 16 T: 2 S: 1 |

PDA ® technology; D129G 1IIS template structure; –carbohydrate; floated 120 C, 122 C, 132 C, 155 C

TABLE 42

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | E | L | L | L | E | E | E | Q | L | E |
| 265 A | All 20 | D | G | G | G | G | G | G | G | G | G | G |
| 297 B | Asp | N | D | D | D | D | D | D | D | D | D | D |
| 299 A | All 20 | T | S | K | K | F | F | F | K | F | K | F |

SPA ™ technology; D129G 1IIS template structure; –carbohydrate; floated 120 C, 122 C, 132 C, 155 C

TABLE 43

| Position | Considered Amino Acids | WT | Ground State | Sequences Around Ground State |
|---|---|---|---|---|
| 239 B | Boundary XM | S | L | L: 194 T: 122 S: 120 E: 111 D: 79 K: 71 A: 62 Q: 57 R: 43 H: 43 N: 37 I: 24 W: 24 V: 13 |
| 265 B | Boundary XM | D | W | Y: 248 W: 233 F: 198 K: 84 D: 57 E: 55 H: 42 R: 28 Q: 20 A: 10 T: 10 N: 8 S: 7 |
| 297 B | Asp | N | D | D: 1000 |
| 299 B | Boundary XM | T | Y | Y: 493 F: 380 H: 76 T: 31 E: 10 D: 4 A: 3 S: 3 |

PDA ® technology; D129G 1E4K template structure; –carbohydrate; floated 117 C, 119 C, 129 C, 152 C

TABLE 44

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | R | E | P | L | L | F | P | P | L | L |
| 265 B | All 20 | D | D | K | S | F | S | Y | A | M | A | D |
| 297 B | Asp | N | D | D | D | D | D | D | D | D | D | D |
| 299 B | All 20 | T | Y | Y | Y | Y | E | Y | Y | Y | Y | Y |

SPA ™ technology; D129G 1E4K template structure; –carbohydrate; floated 117 C, 119 C, 129 C, 152 C

TABLE 45

| Position | Considered Amino Acids | WT | Ground State | Sequences Around Ground State |
|---|---|---|---|---|
| 239 A | Boundary XM | S | E | E: 251 L: 125 D: 120 Q: 112 S: 73 K: 65 I: 61 A: 58 T: 45 N: 35 R: 28 V: 23 W: 4 |
| 265 A | Boundary XM | D | Y | Y: 216 H: 153 K: 135 D: 109 W: 104 F: 86 R: 54 T: 38 E: 29 Q: 22 A: 21 N: 17 S: 13 L: 3 |
| 297 A | Asp | N | D | D: 1000 |

PDA ® technology; D129G 1IIS template structure; –carbohydrate; floated 299 A, 120 C, 122 C, 132 C, 155 C

TABLE 46

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 A | All 20 | S | S | L | E | L | Q | Q | E | Q | Q | E |
| 265 A | All 20 | D | G | G | G | G | G | G | G | G | G | G |
| 297 A | Asp | N | D | D | D | D | D | D | D | D | D | D |

SPA ™ technology; D129G 1IIS template structure; –carbohydrate; floated 299 A, 120 C, 122 C, 132 C, 155 C

TABLE 47

| Position | Considered Amino Acids | WT | Ground State | Sequences Around Ground State |
|---|---|---|---|---|
| 239 B | Boundary XM | S | L | L: 158 S: 137 T: 125 E: 115 D: 86 K: 75 A: 62 Q: 56 H: 43 R: 39 N: 35 W: 30 I: 24 V: 15 |
| 265 B | Boundary XM | D | Y | Y: 188 W: 159 F: 156 D: 122 K: 77 E: 71 H: 61 Q: 44 R: 39 A: 24 S: 22 N: 19 T: 18 |
| 297 B | Asp | N | D | D: 1000 |

PDA ® technology; D129G 1E4K template structure; –carbohydrate; floated 299 B, 117 C, 119 C, 129 C, 152 C

TABLE 48

| Position | Considered Amino Acids | WT | 1 | 2 | 3 | 4 | 5 | 6 | 7 | 8 | 9 | 10 |
|---|---|---|---|---|---|---|---|---|---|---|---|---|
| 239 B | All 20 | S | S | E | P | P | E | S | P | L | F | L |
| 265 B | All 20 | D | A | K | A | M | K | F | Y | D | F | F |
| 297 B | Asp | N | D | D | D | D | D | D | D | D | D | D |

SPA ™ technology; D129G 1E4K template structure; –carbohydrate; floated 299 B, 117 C, 119 C, 129 C, 152 C

TABLE 49

| Position | Considered Amino Acids | WT | Ground State | Sequences Around Ground State |
|---|---|---|---|---|
| 297 A | Asp | N | D | D: 1000 |
| 299 A | Boundary XM | T | Y | T: 123 Y: 64 H: 64 K: 64 Q: 64 F: 64 R: 63 D: 63 E: 63 S: 63 L: 63 N: 62 I: 57 A: 54 V: 52 W: 17 |

PDA ® technology; D129G 1IIS template structure; –carbohydrate; floated 239 A, 265 A, 120 C, 122 C, 132 C, 155 C

TABLE 50

| Position | Considered Amino Acids | WT | 1 | 2 | 3 | 4 | 5 | 6 | 7 | 8 | 9 | 10 |
|---|---|---|---|---|---|---|---|---|---|---|---|---|
| 297 A | Asp | N | D | D | D | D | D | D | D | D | D | D |
| 299 A | All 20 | T | K | K | K | K | F | F | K | K | K | K |

SPA ™ technology; D129G 1IIS template structure; –carbohydrate; floated 239 A, 265 A, 120 C, 122 C, 132 C, 155 C

TABLE 51

| Position | Considered Amino Acids | WT | Ground State | Sequences Around Ground State |
|---|---|---|---|---|
| 297 B | Asp | N | D | D: 1000 |
| 299 B | Boundary XM | T | Y | T: 123 F: 64 Y: 64 H: 64 S: 63 N: 61 Q: 61 D: 61 E: 60 K: 58 V: 57 A: 57 R: 54 I: 52 L: 51 W: 50 |

PDA ® technology; D129G 1E4K template structure; –carbohydrate; floated 239 B, 265 B, 117 C, 119 C, 129 C, 152 C

TABLE 52

| Position | Considered Amino Acids | WT | 1 | 2 | 3 | 4 | 5 | 6 | 7 | 8 | 9 | 10 |
|---|---|---|---|---|---|---|---|---|---|---|---|---|
| 297 B | Asp | N | D | D | D | D | D | D | D | D | D | D |
| 299 B | All 20 | T | Y | Y | Y | Y | Y | Y | Y | Y | Y | Y |

SPA ™ technology; D129G 1E4K template structure; –carbohydrate; floated 239 B, 265 B, 117 C, 119 C, 129 C, 152 C Computational screening calculations were carried out to optimize aglycosylated Fc by designing favorable substitutions at residues that are exposed to solvent in the absence of glycosylation such that they are stable, maintain Fc structure, and have no tendency to aggregate. The N297 carbohydrate covers up the exposed hydrophobic patch that would normally be the interface for a protein-protein interaction with another Ig domain, maintaining the stability and structural integrity of Fc and keeping the Cγ2 domains from aggregating across the central axis. Key residues for design are F241, F243, V262, and V264, which reside behind the carbohydrate on Cγ2, in addition to residues such as L328, I332, and I336, which are exposed nonpolar residues facing inward towards the opposed Cγ2 domain, that were considered in previously presented calculations. The importance of these Cγ2 residues is supported by noting that the corresponding residues in the Cγ3 domain by sequence alignment either mediate the nonpolar interaction between the two Cγ3 domains or are buried in the Cγ3 core. The results of these design calculations are presented in Table 53.

TABLE 53

| Position | Considered Amino Acids | WT | Ground State | Sequences Around Ground State |
|---|---|---|---|---|
| 241 A | Surface | F | E | E: 190 R: 172 K: 138 H: 117 T: 93 Q: 91 D: 85 S: 49 N: 49 A: 16 |
| 243 A | Surface | F | R | R: 190 H: 164 Q: 152 E: 149 K: 92 T: 71 D: 64 N: 58 S: 42 A: 18 |
| 262 A | Surface | V | D | D: 416 E: 164 N: 138 Q: 87 T: 83 R: 44 S: 32 K: 24 A: 11 H: 1 |
| 264 A | Surface | V | H | R: 368 H: 196 K: 147 E: 108 Q: 68 T: 34 N: 33 D: 25 S: 15 A: 6 |

PDA ® technology; 1IIS template structure; –carbohydrate

In a final set of calculations, a SPA™ computational screening method was applied to evaluate the replacement of all chosen variable positions with all 20 amino acids. The lowest energy rotamer conformation for all 20 amino acids was determined, and this energy was defined as the energy of substitution for that amino acid at that variable position. These calculations thus provided an energy of substitution for each of the 20 amino acids at each variable position. The calculations used various template structures including different Fc/FcγRIIIb complexes (1IIS, 1IIX, 1E4K), a modeled Fc/FcγRIIb complex, and uncomplexed Fc (1D/V2), and thus were useful for a variety of design goals aimed at both glycosylated and aglycosylated Fc, including optimization of Fc/FcγR affinity, C1q affinity, Fc stability, Fc solubility, carbohydrate conformation, and hinge conformation. Furthermore, because these calculations provide energies for both favorable and unfavorable substitutions, they guide substitutions that may enable differential binding to activating versus inhibitory FcγRs. Various template structures were used, and calculations explored substitutions on both chains. The results of these calculations and relevant parameters and information are presented in Tables 54-60 below. Column 1 lists the variable positions on chain A and B of the template structure. Column 2 lists the wild-type amino acid identity at each variable position. The remaining 20 columns provide the energy for each of the natural 20 amino acids (shown in the top row). All substitutions were normalized with respect to the lowest energy substitution, which was set to 0 energy. For example in Table 54, for L235 on chain A, serine is the lowest energy substitution, and L235A is 0.9 kcal/mol less stable than L235S. Extremely high energies were set to 20 kcal/mol for energies between 20-50 kcal/mol, and 50 kcal/mold for energies greater than 50 kcal/mol. Favorable substitutions may be considered to be the lowest energy substitution for each position, and substitutions that have small energy differences from the lowest energy substitution, for example substitutions within 1-2, 1-3, 1-5, or 1-10 kcal/mol.

TABLE 54

| Pos | WT | A | C | D | E | F | G | H | I | K | L | M |
|---|---|---|---|---|---|---|---|---|---|---|---|---|
| 235 A | L | 0.9 | 2.8 | 2.8 | 1.5 | 3.2 | 3.2 | 3.4 | 4.9 | 1.6 | 2.1 | 3.2 |
| 236 A | G | 0 | 1.9 | 5.1 | 6.7 | 10 | 2.3 | 4.3 | 17.2 | 5.7 | 20 | 4.6 |
| 237 A | G | 20 | 20 | 20 | 50 | 50 | 0 | 50 | 50 | 20 | 50 | 20 |
| 239 A | S | 0.2 | 4.3 | 2.6 | 0 | 12.8 | 4.5 | 6.9 | 11.3 | 1.7 | 0.1 | 2.1 |
| 265 A | D | 9.0 | 8.1 | 6.3 | 7.8 | 5.1 | 0 | 7.3 | 50 | 8.2 | 9.9 | 7.7 |
| 267 A | S | 2.1 | 3.3 | 7.3 | 1.4 | 50 | 7.3 | 20 | 20 | 0.9 | 2.2 | 5.0 |
| 269 A | E | 0.5 | 2.1 | 1.3 | 0.6 | 1.6 | 3.9 | 2.0 | 1.2 | 1.1 | 1.3 | 2.7 |
| 270 A | D | 0.3 | 2.8 | 2.3 | 2.0 | 4.0 | 4.0 | 3.4 | 2.4 | 1.2 | 0 | 2.3 |
| 296 A | Y | 2.7 | 2.0 | 1.4 | 0 | 50 | 0 | 50 | 4.6 | 2.1 | 2.4 | 3.3 |
| 298 A | S | 0.7 | 2.4 | 6.7 | 3.4 | 20 | 3.9 | 20 | 6.7 | 0 | 4.1 | 1.4 |
| 299 A | T | 0.6 | 2.8 | 11.5 | 10.1 | 20 | 6.1 | 20 | 10.7 | 7.1 | 20 | 4.3 |
| 234 B | L | 2.1 | 3.2 | 4.1 | 4.2 | 1.6 | 5.3 | 0.1 | 0.7 | 0.6 | 1.0 | 2.0 |
| 235 B | L | 0.6 | 2.3 | 2.5 | 0.7 | 5.4 | 4.8 | 1.4 | 3.6 | 0.1 | 0 | 2.0 |
| 236 B | G | 3.1 | 1.3 | 4.4 | 8.2 | 5.2 | 0 | 1.9 | 20 | 3.1 | 20 | 4.1 |
| 237 B | G | 20 | 50 | 50 | 50 | 50 | 0 | 50 | 50 | 50 | 50 | 50 |
| 239 B | S | 0.9 | 2.4 | 3.4 | 1.8 | 5.4 | 5.6 | 2.7 | 3.0 | 0.9 | 0 | 2.0 |
| 265 B | D | 4.5 | 5.1 | 4.6 | 4.6 | 4.9 | 0 | 3.8 | 9.0 | 2.0 | 2.5 | 4.1 |
| 327 B | A | 1.8 | 3.4 | 4.7 | 3.9 | 20 | 7.0 | 20 | 20 | 0.8 | 0 | 1.9 |
| 328 B | L | 3.7 | 3.6 | 4.0 | 3.7 | 50 | 8.4 | 6.8 | 50 | 3.8 | 0 | 2.1 |
| 329 B | P | 3.4 | 8.6 | 20 | 20 | 50 | 8.0 | 16.8 | 50 | 20 | 20 | 16.9 |
| 330 B | A | 0.5 | 2.0 | 2.6 | 0.5 | 2.4 | 3.8 | 1.4 | 4.2 | 0 | 2.0 | 2.2 |
| 332 B | I | 1.5 | 2.7 | 1.2 | 1.6 | 11.9 | 6.8 | 12.9 | 1.2 | 2.9 | 0 | 1.4 |

| Pos | N | P | Q | R | S | T | V | W | Y |
|---|---|---|---|---|---|---|---|---|---|
| 235 A | 0.9 | 0.3 | 1.3 | 0.7 | 0 | 1.7 | 4.3 | 6.5 | 3.2 |
| 236 A | 3.2 | 12.6 | 5.6 | 6.1 | 0.6 | 6.2 | 12.0 | 6.7 | 20 |
| 237 A | 20 | 50 | 50 | 50 | 20 | 20 | 50 | 50 | 50 |
| 239 A | 1.7 | 7.9 | 1.2 | 2.6 | 0.3 | 5.7 | 11.0 | 20 | 20 |
| 265 A | 6.0 | 50 | 9.0 | 8.5 | 7.8 | 20 | 50 | 20 | 5.8 |
| 267 A | 4.8 | 0 | 2.2 | 3.1 | 2.9 | 20 | 20 | 50 | 50 |
| 269 A | 0 | 50 | 0.6 | 1.1 | 0.3 | 0.8 | 1.0 | 5.6 | 1.2 |
| 270 A | 2.1 | 20 | 2.0 | 2.3 | 1.4 | 1.8 | 4.2 | 5.4 | 6.0 |
| 296 A | 1.2 | 50 | 0.2 | 1.5 | 1.3 | 4.6 | 4.4 | 16.3 | 18.2 |
| 298 A | 4.1 | 50 | 1.8 | 1.1 | 0.2 | 2.2 | 6.3 | 17.8 | 20 |
| 299 A | 6.8 | 50 | 6.3 | 12.0 | 0 | 3.0 | 7.1 | 14.8 | 20 |
| 234 B | 1.7 | 50 | 2.8 | 0.3 | 2.3 | 1.7 | 2.6 | 13.0 | 0 |
| 235 B | 1.7 | 16.6 | 0.5 | 1.2 | 0.7 | 0.7 | 5.3 | 6.8 | 5.5 |
| 236 B | 2.7 | 50 | 3.7 | 16.0 | 1.2 | 20 | 20 | 20 | 11.3 |
| 237 B | 50 | 50 | 50 | 50 | 50 | 50 | 50 | 50 | 50 |
| 239 B | 1.6 | 50 | 1.8 | 1.8 | 1.4 | 1.4 | 5.1 | 20 | 5.3 |
| 265 B | 2.1 | 50 | 4.5 | 5.1 | 4.4 | 5.9 | 9.2 | 11.4 | 5.8 |

TABLE 54-continued

|  |  |  |  |  |  |  |  |  |  |
|---|---|---|---|---|---|---|---|---|---|
| 327 B | 1.5 | 20 | 3.0 | 2.6 | 3.2 | 20 | 20 | 20 | 20 |
| 328 B | 4.1 | 50 | 3.6 | 8.1 | 4.9 | 3.0 | 12.5 | 50 | 50 |
| 329 B | 20 | 0 | 20 | 20 | 1.3 | 17.1 | 16.5 | 50 | 50 |
| 330 B | 0.8 | 20 | 0.1 | 0.6 | 0.9 | 0.3 | 5.1 | 8.0 | 2.7 |
| 332 B | 1.7 | 50 | 1.3 | 4.9 | 1.8 | 1.7 | 3.0 | 20 | 20 |

SPA ™ technology; 1IIS template structure; +carbohydrate atoms, no floated positions

TABLE 55

| Pos | WT | A | C | D | E | F | G | H | I | K | L |
|---|---|---|---|---|---|---|---|---|---|---|---|
| 235 A | L | 0.9 | 2.8 | 2.6 | 1.7 | 3.3 | 3.3 | 3.4 | 5.0 | 1.6 | 2.1 |
| 236 A | G | 0 | 1.7 | 5.2 | 6.0 | 11.3 | 2.3 | 4.4 | 17.2 | 5.8 | 19.0 |
| 237 A | G | 20 | 20 | 20 | 50 | 50 | 0 | 50 | 50 | 20 | 50 |
| 238 A | P | 8.6 | 8.0 | 10.5 | 13.4 | 6.4 | 0 | 5.0 | 50 | 12.4 | 11.3 |
| 239 A | S | 0.1 | 4.2 | 2.5 | 0 | 20 | 4.5 | 9.0 | 10.8 | 1.8 | 0.2 |
| 240 A | V | 1.3 | 2.4 | 2.3 | 6.3 | 20 | 7.2 | 20 | 5.1 | 10.8 | 6.2 |
| 241 A | F | 0.1 | 1.6 | 1.2 | 0.3 | 0.2 | 4.1 | 1.2 | 10 | 1.3 | 0.1 |
| 242 A | L | 3.0 | 3.4 | 5.5 | 8.3 | 14.4 | 8.5 | 11.1 | 3.3 | 13.9 | 2.2 |
| 243 A | F | 1.6 | 2.2 | 2.7 | 0.2 | 1.4 | 5.6 | 2.5 | 0 | 2.2 | 2.0 |
| 244 A | P | 1.2 | 1.8 | 3.8 | 0.8 | 10.2 | 3.8 | 4.6 | 20 | 0.2 | 2.9 |
| 245 A | P | 3.9 | 20 | 20 | 20 | 20 | 9.1 | 20 | 20 | 20 | 20 |
| 246 A | K | 1.3 | 2.7 | 2.0 | 2.0 | 2.9 | 5.7 | 2.9 | 1.4 | 1.4 | 1.5 |
| 247 A | P | 1.2 | 2.1 | 0.3 | 0.7 | 4.0 | 3.9 | 3.7 | 1.8 | 1.6 | 1.7 |
| 248 A | K | 0.9 | 2.7 | 1.5 | 0.8 | 3.1 | 4.7 | 3.4 | 3.3 | 2.0 | 1.9 |
| 249 A | D | 1.2 | 3.7 | 1.6 | 0 | 20 | 7.3 | 19.7 | 50 | 1.7 | 20 |
| 250 A | T | 0 | 1.8 | 3.8 | 5.8 | 50 | 6.0 | 20 | 4.5 | 6.3 | 6.3 |
| 251 A | L | 1.1 | 1.9 | 1.2 | 0.5 | 5.8 | 5.1 | 1.9 | 5.6 | 0.9 | 0.7 |
| 252 A | M | 0.3 | 1.2 | 0.6 | 0 | 3.0 | 3.8 | 3.4 | 3.9 | 1.0 | 0.3 |
| 253 A | I | 0.7 | 1.7 | 1.1 | 0.2 | 1.8 | 3.5 | 2.2 | 2.0 | 0.3 | 1.2 |
| 254 A | S | 0.7 | 1.7 | 0.4 | 0.7 | 2.2 | 3.6 | 2.0 | 0.3 | 1.2 | 1.9 |
| 255 A | R | 1.4 | 2.8 | 2.4 | 2.5 | 0.2 | 5.4 | 1.1 | 17.0 | 1.0 | 2.2 |
| 256 A | T | 0.6 | 1.8 | 1.2 | 1.1 | 2.7 | 3.4 | 2.1 | 1.4 | 0.7 | 1.5 |
| 257 A | P | 0 | 7.8 | 20 | 12.9 | 50 | 6.2 | 50 | 20 | 12.3 | 12.8 |
| 258 A | E | 0 | 1.6 | 4.8 | 2.6 | 1.0 | 4.3 | 2.2 | 14.8 | 4.4 | 6.2 |
| 259 A | V | 3.9 | 4.3 | 5.1 | 8.7 | 20 | 10.3 | 6.8 | 2.3 | 9.6 | 2.8 |
| 260 A | T | 1.7 | 2.3 | 3.3 | 1.1 | 20 | 6.6 | 8.6 | 0 | 0.2 | 1.8 |
| 261 A | C | 0 | 20 | 20 | 20 | 20 | 3.9 | 20 | 20 | 20 | 20 |
| 262 A | V | 1.9 | 3.2 | 0 | 3.3 | 20 | 7.2 | 20 | 8.3 | 2.9 | 2.9 |
| 263 A | V | 2.2 | 2.7 | 6.0 | 17.4 | 20 | 8.8 | 20 | 10 | 7.1 | 7.6 |
| 264 A | V | 1.9 | 3.3 | 2.8 | 2.2 | 0 | 6.4 | 2.1 | 0.7 | 2.6 | 0.9 |
| 265 A | D | 9.0 | 8.1 | 5.9 | 8.6 | 5.3 | 0 | 7.3 | 50 | 7.9 | 9.7 |
| 266 A | V | 4.9 | 5.3 | 7.1 | 12.1 | 20 | 11.2 | 20 | 0.4 | 12.2 | 20 |
| 267 A | S | 2.3 | 3.5 | 7.2 | 1.3 | 50 | 7.4 | 20 | 20 | 0.7 | 1.4 |
| 268 A | H | 1.2 | 1.9 | 2.2 | 1.5 | 3.7 | 5.0 | 4.9 | 0.4 | 0.5 | 3.7 |
| 269 A | E | 0.3 | 1.9 | 1.3 | 0.5 | 1.3 | 3.7 | 1.9 | 1.1 | 0.8 | 1.2 |
| 270 A | D | 0.2 | 2.6 | 2.1 | 1.9 | 5.2 | 3.9 | 3.1 | 2.1 | 1.2 | 0 |
| 271 A | P | 0 | 5.3 | 8.1 | 9.3 | 20 | 3.1 | 9.1 | 20 | 6.0 | 9.5 |
| 272 A | Q | 0.8 | 1.9 | 0.9 | 1.2 | 3.0 | 3.2 | 3.7 | 3.7 | 1.6 | 1.8 |
| 273 A | V | 1.2 | 2.9 | 1.8 | 20 | 20 | 7.1 | 20 | 6.8 | 20 | 20 |
| 274 A | K | 0.4 | 1.8 | 1.4 | 0.8 | 1.9 | 3.9 | 2.4 | 1.4 | 0.7 | 1.1 |
| 275 A | F | 8.0 | 9.5 | 10.3 | 9.5 | 0 | 13.5 | 5.1 | 10.1 | 6.2 | 6.3 |
| 276 A | N | 1.3 | 2.4 | 2.4 | 2.2 | 0.8 | 5.1 | 0.8 | 1.2 | 0.6 | 2.3 |
| 277 A | W | 5.5 | 7.4 | 8.4 | 6.4 | 15.4 | 11.2 | 3.2 | 8.2 | 1.9 | 3.9 |
| 278 A | Y | 1.6 | 2.7 | 3.9 | 1.6 | 1.0 | 7.3 | 3.4 | 17.7 | 1.4 | 7.5 |
| 279 A | V | 3.1 | 4.1 | 4.0 | 2.2 | 20 | 8.1 | 9.7 | 8.5 | 0 | 1.4 |
| 280 A | D | 1.8 | 2.6 | 2.7 | 0.2 | 11.5 | 2.9 | 8.8 | 20 | 3.4 | 3.2 |
| 281 A | G | 50 | 50 | 50 | 50 | 50 | 0 | 50 | 50 | 50 | 50 |
| 282 A | V | 0.9 | 2.1 | 1.6 | 1.1 | 2.9 | 4.2 | 3.5 | 1.4 | 1.5 | 1.8 |
| 283 A | E | 0.7 | 1.6 | 0.7 | 0.5 | 1.0 | 4.4 | 1.4 | 0.4 | 1.2 | 1.8 |
| 284 A | V | 0 | 2.2 | 3.1 | 1.2 | 20 | 5.0 | 20 | 4.0 | 0.7 | 2.6 |
| 285 A | H | 0.2 | 1.4 | 3.1 | 1.3 | 3.0 | 2.0 | 2.4 | 3.6 | 1.1 | 2.6 |
| 286 A | N | 0.8 | 2.5 | 1.2 | 1.1 | 2.4 | 4.7 | 2.7 | 2.1 | 0 | 0.7 |
| 287 A | A | 0.6 | 2.6 | 5.8 | 3.3 | 10.4 | 5.4 | 9.1 | 11.3 | 0 | 4.4 |
| 288 A | K | 0.8 | 2.6 | 2.0 | 1.3 | 3.0 | 3.4 | 3.8 | 2.3 | 1.4 | 1.7 |
| 289 A | T | 0.3 | 1.9 | 4.7 | 1.1 | 3.1 | 3.6 | 2.9 | 10.5 | 0.4 | 2.7 |
| 290 A | K | 1.7 | 2.2 | 0.5 | 0.6 | 3.0 | 1.3 | 3.0 | 3.7 | 1.7 | 2.1 |
| 291 A | P | 1.6 | 3.1 | 1.8 | 0.5 | 1.9 | 5.5 | 1.8 | 0.1 | 0.5 | 1.5 |
| 292 A | R | 1.1 | 2.2 | 3.1 | 0.8 | 5.9 | 4.4 | 8.0 | 5.0 | 0 | 1.6 |
| 293 A | E | 2.2 | 6.5 | 9.0 | 17.9 | 16.3 | 0 | 13.2 | 50 | 12.8 | 10.3 |
| 294 A | E | 1.5 | 2.1 | 2.1 | 0.7 | 8.1 | 2.8 | 3.3 | 2.0 | 2.6 | 1.8 |
| 295 A | Q | 50 | 50 | 50 | 50 | 50 | 0 | 50 | 50 | 50 | 50 |
| 296 A | Y | 2.8 | 2.3 | 1.1 | 0.4 | 50 | 0 | 50 | 4.6 | 2.2 | 2.3 |
| 297 A | N | 0 | 6.5 | 8.4 | 5.3 | 20 | 3.4 | 20 | 13.8 | 2.7 | 20 |
| 298 A | S | 0.8 | 2.4 | 5.7 | 2.2 | 20 | 3.7 | 20 | 6.2 | 0.9 | 9.2 |
| 299 A | T | 1.9 | 3.4 | 6.0 | 3.1 | 1.0 | 7.1 | 2.9 | 3.1 | 0 | 2.7 |

TABLE 55-continued

| | | | | | | | | | | | |
|---|---|---|---|---|---|---|---|---|---|---|---|
| 300 A | Y | 2.8 | 2.9 | 2.7 | 4.5 | 20 | 4.0 | 7.5 | 13.1 | 1.2 | 0 |
| 301 A | R | 3.0 | 3.5 | 3.8 | 2.8 | 0.8 | 3.4 | 1.8 | 0 | 1.3 | 0.7 |
| 302 A | V | 2.7 | 4.6 | 6.7 | 3.9 | 2.8 | 8.9 | 1.2 | 6.9 | 2.7 | 2.0 |
| 303 A | V | 0 | 2.2 | 3.3 | 1.0 | 6.7 | 4.5 | 5.3 | 1.4 | 2.5 | 3.1 |
| 304 A | S | 0 | 12.1 | 10.8 | 20 | 20 | 6.2 | 20 | 20 | 17.2 | 20 |
| 305 A | V | 1.1 | 2.3 | 3.3 | 1.2 | 0.3 | 5.4 | 1.2 | 0 | 0.9 | 1.1 |
| 306 A | L | 4.3 | 6.2 | 7.1 | 5.9 | 2.8 | 10.4 | 3.4 | 13.7 | 3.0 | 0 |
| 307 A | T | 1.4 | 3.2 | 3.8 | 2.2 | 6.5 | 5.5 | 4.2 | 0.5 | 0.3 | 4.2 |
| 308 A | V | 1.8 | 5.5 | 6.5 | 8.0 | 50 | 7.9 | 20 | 4.5 | 20 | 5.5 |
| 309 A | L | 1.1 | 2.7 | 0.7 | 0.7 | 1.3 | 4.6 | 2.7 | 0.7 | 1.7 | 1.0 |
| 310 A | H | 2.0 | 2.6 | 0.9 | 4.1 | 50 | 5.6 | 0.2 | 6.8 | 4.0 | 7.1 |
| 311 A | Q | 0.6 | 2.5 | 1.6 | 1.6 | 2.5 | 4.3 | 1.6 | 1.4 | 0.6 | 0.9 |
| 312 A | N | 5.4 | 5.1 | 5.9 | 1.3 | 20 | 0 | 20 | 10 | 3.4 | 4.8 |
| 313 A | W | 4.6 | 6.4 | 5.5 | 5.6 | 1.1 | 10.8 | 5.0 | 11.0 | 5.8 | 5.2 |
| 314 A | L | 2.1 | 2.9 | 4.3 | 2.2 | 5.7 | 6.1 | 7.9 | 5.4 | 0.7 | 0 |
| 315 A | D | 0.3 | 1.4 | 1.5 | 0.1 | 3.3 | 4.2 | 1.9 | 1.8 | 0.8 | 0.5 |
| 316 A | G | 50 | 50 | 50 | 50 | 50 | 0 | 50 | 50 | 50 | 50 |
| 317 A | K | 0 | 14.0 | 18.4 | 17.9 | 50 | 5.0 | 50 | 20 | 8.5 | 12.5 |
| 318 A | E | 2.0 | 3.0 | 2.7 | 1.7 | 2.7 | 6.7 | 2.6 | 0 | 1.1 | 1.6 |
| 319 A | Y | 2.9 | 4.4 | 3.9 | 3.4 | 0 | 8.8 | 1.8 | 20 | 0.5 | 5.2 |
| 320 A | K | 2.3 | 3.1 | 3.0 | 2.7 | 20 | 7.8 | 20 | 9.4 | 0 | 0.6 |
| 321 A | C | 0 | 3.2 | 20 | 18.8 | 20 | 6.9 | 20 | 20 | 20 | 20 |
| 322 A | K | 2.0 | 2.5 | 3.5 | 2.8 | 2.7 | 6.4 | 2.1 | 0.2 | 0.1 | 1.2 |
| 323 A | V | 1.5 | 2.8 | 7.3 | 11.9 | 20 | 8.1 | 20 | 6.0 | 9.6 | 20 |
| 324 A | S | 2.0 | 2.1 | 0.6 | 0 | 1.9 | 4.9 | 3.9 | 1.5 | 2.8 | 0.7 |
| 325 A | N | 2.8 | 3.9 | 8.4 | 3.0 | 20 | 8.3 | 20 | 0 | 7.7 | 20 |
| 326 A | K | 1.0 | 2.7 | 3.0 | 1.6 | 3.7 | 4.1 | 3.1 | 3.2 | 1.7 | 2.4 |
| 327 A | A | 0.9 | 2.8 | 5.8 | 3.1 | 20 | 6.3 | 16.7 | 14.7 | 2.8 | 20 |
| 328 A | L | 6.0 | 6.3 | 7.0 | 4.1 | 50 | 8.6 | 20 | 50 | 5.7 | 0 |
| 329 A | P | 1.0 | 2.5 | 0.9 | 0.6 | 4.0 | 3.4 | 3.3 | 1.7 | 1.9 | 2.5 |
| 330 A | A | 0.9 | 2.0 | 1.3 | 0.7 | 3.4 | 3.8 | 3.0 | 2.0 | 1.4 | 2.0 |
| 331 A | P | 50 | 50 | 50 | 50 | 50 | 0 | 50 | 50 | 50 | 50 |
| 332 A | I | 1.9 | 3.7 | 4.6 | 1.7 | 5.0 | 7.0 | 1.9 | 3.8 | 1.8 | 0 |
| 333 A | E | 0 | 3.1 | 3.2 | 0.8 | 4.1 | 4.4 | 4.2 | 16.9 | 3.6 | 2.8 |
| 334 A | K | 1.7 | 2.9 | 2.5 | 0 | 1.0 | 6.1 | 3.3 | 1.0 | 1.5 | 0.5 |
| 335 A | T | 0.5 | 3.2 | 4.5 | 2.7 | 4.2 | 4.9 | 4.1 | 20 | 2.1 | 3.1 |
| 336 A | I | 1.2 | 1.6 | 5.0 | 1.5 | 20 | 6.1 | 16.8 | 0.7 | 3.4 | 7.8 |
| 337 A | S | 4.8 | 4.8 | 7.5 | 11.5 | 10.1 | 0 | 5.5 | 50 | 9.9 | 7.0 |
| 338 A | K | 1.0 | 2.7 | 2.3 | 2.2 | 4.6 | 5.9 | 2.4 | 50 | 0 | 2.1 |
| 339 A | A | 1.0 | 2.5 | 0.8 | 1.1 | 4.4 | 3.7 | 3.7 | 2.1 | 1.8 | 2.6 |
| 340 A | K | 1.3 | 2.4 | 2.3 | 2.0 | 1.7 | 4.1 | 2.3 | 1.9 | 0 | 2.3 |
| 232 B | P | 1.3 | 3.2 | 2.2 | 2.2 | 4.1 | 2.9 | 3.6 | 1.8 | 2.1 | 2.8 |
| 233 B | E | 0.5 | 2.2 | 1.7 | 0.5 | 2.6 | 3.7 | 2.9 | 4.4 | 1.4 | 1.1 |
| 234 B | L | 2.9 | 4.0 | 4.8 | 4.9 | 2.0 | 6.1 | 0.8 | 1.5 | 0 | 1.9 |
| 235 B | L | 0.6 | 2.3 | 2.4 | 0.9 | 5.7 | 4.9 | 1.4 | 3.7 | 0 | 0 |
| 236 B | G | 3.6 | 2.5 | 5.1 | 11.8 | 6.8 | 0 | 2.8 | 20 | 5.0 | 20 |
| 237 B | G | 20 | 50 | 50 | 50 | 50 | 0 | 50 | 50 | 50 | 50 |
| 238 B | P | 3.5 | 4.7 | 8.5 | 4.2 | 20 | 9.8 | 20 | 0 | 5.6 | 9.6 |
| 239 B | S | 1.0 | 2.5 | 3.4 | 2.0 | 7.2 | 5.7 | 3.1 | 3.1 | 0.6 | 0 |
| 240 B | V | 0.1 | 2.3 | 7.0 | 11.9 | 20 | 6.5 | 20 | 8.1 | 12.7 | 20 |
| 241 B | F | 0 | 2.0 | 1.4 | 0.8 | 1.0 | 4.0 | 2.0 | 6.5 | 1.1 | 0.6 |
| 242 B | L | 2.2 | 3.3 | 6.5 | 6.6 | 6.9 | 7.9 | 4.3 | 0 | 8.7 | 3.9 |
| 243 B | F | 0.8 | 2.6 | 1.9 | 1.7 | 0.8 | 4.9 | 2.0 | 3.6 | 1.2 | 0.8 |
| 244 B | P | 1.1 | 2.1 | 4.0 | 1.1 | 11.9 | 3.5 | 5.4 | 20 | 1.4 | 3.2 |
| 245 B | P | 3.2 | 20 | 20 | 20 | 20 | 8.6 | 20 | 20 | 20 | 20 |
| 246 B | K | 0.5 | 2.6 | 1.4 | 1.2 | 2.1 | 4.4 | 1.6 | 0.6 | 0.9 | 1.4 |
| 247 B | P | 0.8 | 2.5 | 0.7 | 1.0 | 3.6 | 3.9 | 2.6 | 6.2 | 1.8 | 2.1 |
| 248 B | K | 0.2 | 2.2 | 0.2 | 0.6 | 2.2 | 4.1 | 2.5 | 2.4 | 1.7 | 1.0 |
| 249 B | D | 2.8 | 3.3 | 0 | 4.6 | 10.1 | 8.2 | 6.5 | 50 | 4.6 | 6.2 |
| 250 B | T | 0 | 2.2 | 4.9 | 2.8 | 20 | 6.3 | 20 | 2.2 | 4.3 | 3.2 |
| 251 B | L | 0 | 2.4 | 1.6 | 1.2 | 5.6 | 3.6 | 2.2 | 7.4 | 12 | 0.6 |
| 252 B | M | 1.3 | 2.4 | 0.8 | 0 | 1.8 | 5.7 | 2.3 | 0.6 | 1.6 | 0.6 |
| 253 B | I | 1.6 | 3.0 | 2.0 | 1.2 | 3.7 | 4.5 | 3.5 | 2.9 | 0.8 | 2.4 |
| 254 B | S | 1.0 | 1.5 | 0.8 | 0.6 | 3.8 | 3.8 | 3.2 | 0.5 | 1.9 | 2.5 |
| 255 B | R | 0.9 | 2.0 | 2.0 | 1.7 | 0 | 5.4 | 1.4 | 20 | 1.0 | 1.6 |
| 256 B | T | 0.6 | 2.0 | 1.8 | 1.1 | 2.5 | 3.7 | 1.9 | 1.6 | 1.0 | 1.4 |
| 257 B | P | 2.5 | 20 | 20 | 20 | 50 | 9.0 | 50 | 20 | 20 | 20 |
| 258 B | E | 1.5 | 2.4 | 2.7 | 1.4 | 2.7 | 6.4 | 4.2 | 0 | 0.2 | 5.4 |
| 259 B | V | 2.9 | 4.2 | 6.3 | 5.2 | 20 | 9.3 | 20 | 0 | 8.1 | 8.9 |
| 260 B | T | 0 | 1.6 | 5.3 | 1.9 | 20 | 4.9 | 20 | 0.6 | 1.1 | 2.8 |
| 261 B | C | 0 | 10 | 20 | 20 | 20 | 2.6 | 20 | 20 | 20 | 20 |
| 262 B | V | 2.1 | 2.4 | 2.7 | 2.4 | 8.1 | 7.2 | 3.8 | 1.8 | 3.5 | 8.8 |
| 263 B | V | 2.2 | 3.7 | 4.7 | 11.2 | 20 | 9.1 | 20 | 15.0 | 13.7 | 2.8 |
| 264 B | V | 2.1 | 3.0 | 4.6 | 2.7 | 8.6 | 6.8 | 6.6 | 0 | 1.8 | 1.8 |
| 265 B | D | 4.5 | 5.2 | 4.8 | 4.7 | 5.0 | 0 | 3.8 | 8.5 | 1.8 | 2.6 |
| 266 B | V | 5.3 | 5.5 | 7.2 | 12.7 | 20 | 12.0 | 20 | 2.1 | 20 | 20 |
| 267 B | S | 2.8 | 4.3 | 6.2 | 3.8 | 0 | 7.4 | 1.0 | 50 | 1.0 | 0.3 |
| 268 B | H | 2.6 | 3.7 | 5.1 | 4.1 | 4.9 | 6.0 | 1.8 | 2.6 | 0 | 2.5 |
| 269 B | E | 0.4 | 2.4 | 1.7 | 0.8 | 2.8 | 3.7 | 2.6 | 1.0 | 1.0 | 1.6 |

TABLE 55-continued

| | | | | | | | | | | | |
|---|---|---|---|---|---|---|---|---|---|---|---|
| 270 B | D | 0 | 1.6 | 1.1 | 7.3 | 4.8 | 4.3 | 2.6 | 20 | 3.8 | 14.5 |
| 271 B | P | 1.1 | 3.3 | 5.6 | 3.4 | 4.1 | 5.5 | 4.2 | 20 | 1.9 | 3.6 |
| 272 B | O | 0.9 | 1.9 | 1.0 | 0.6 | 3.0 | 3.9 | 2.9 | 1.5 | 1.7 | 2.2 |
| 273 B | V | 3.5 | 4.8 | 6.2 | 8.3 | 20 | 9.2 | 20 | 4.6 | 8.4 | 3.1 |
| 274 B | K | 0.1 | 1.6 | 0.4 | 0.9 | 1.7 | 3.8 | 1.8 | 1.9 | 0.4 | 0.5 |
| 275 B | F | 5.7 | 7.0 | 8.4 | 9.2 | 0 | 11.2 | 3.5 | 9.2 | 7.9 | 5.7 |
| 276 B | N | 0 | 6.2 | 6.9 | 6.4 | 20 | 4.7 | 12.1 | 20 | 9.3 | 10 |
| 277 B | W | 8.3 | 10 | 10.6 | 9.2 | 2.6 | 14.2 | 7.4 | 12.7 | 6.7 | 7.4 |
| 278 B | Y | 0 | 2.3 | 17.4 | 4.0 | 50 | 5.1 | 50 | 20 | 2.8 | 20 |
| 279 B | V | 3.1 | 3.5 | 4.2 | 2.9 | 20 | 8.5 | 13.9 | 0.4 | 0 | 2.9 |
| 280 B | D | 0.5 | 3.0 | 2.1 | 1.5 | 6.7 | 3.1 | 4.7 | 12.6 | 2.9 | 1.6 |
| 281 B | G | 5.6 | 5.8 | 5.5 | 4.8 | 7.9 | 0 | 7.2 | 6.5 | 5.3 | 5.7 |
| 282 B | V | 0.4 | 1.9 | 1.1 | 0.6 | 2.9 | 4.1 | 2.1 | 1.3 | 1.0 | 1.4 |
| 283 B | E | 0.6 | 1.9 | 4.3 | 1.7 | 6.7 | 4.2 | 5.2 | 2.9 | 0.5 | 4.4 |
| 284 B | V | 0.4 | 2.4 | 2.5 | 1.1 | 20 | 5.9 | 20 | 1.1 | 1.2 | 6.2 |
| 285 B | H | 1.3 | 2.4 | 2.1 | 1.7 | 2.4 | 3.4 | 1.2 | 1.8 | 0.7 | 2.3 |
| 286 B | N | 1.2 | 2.7 | 1.0 | 1.1 | 3.0 | 3.1 | 2.6 | 0.8 | 2.0 | 1.9 |
| 287 B | A | 2.5 | 4.4 | 6.1 | 7.5 | 0 | 8.2 | 3.0 | 10.2 | 5.1 | 16.5 |
| 288 B | K | 0.4 | 1.9 | 1.9 | 0 | 2.9 | 3.5 | 2.9 | 2.5 | 1.8 | 2.1 |
| 289 B | T | 0.1 | 1.5 | 3.7 | 1.4 | 2.7 | 3.9 | 2.6 | 1.8 | 0 | 2.2 |
| 290 B | K | 0.9 | 1.8 | 0.8 | 0.5 | 2.4 | 0.8 | 2.7 | 3.0 | 1.3 | 1.3 |
| 291 B | P | 1.2 | 2.1 | 2.5 | 0.5 | 3.9 | 4.6 | 3.4 | 0.7 | 0 | 3.4 |
| 292 B | R | 0.8 | 2.6 | 3.3 | 1.2 | 4.9 | 3.6 | 6.8 | 3.1 | 2.0 | 2.4 |
| 293 B | E | 0 | 3.0 | 4.1 | 2.8 | 7.3 | 3.6 | 5.8 | 5.8 | 2.6 | 4.5 |
| 294 B | E | 2.5 | 3.3 | 3.9 | 2.3 | 8.3 | 6.8 | 4.4 | 5.6 | 3.6 | 2.3 |
| 295 B | Q | 1.1 | 2.2 | 1.9 | 0.6 | 3.8 | 2.8 | 3.1 | 8.0 | 1.4 | 2.2 |
| 296 B | Y | 1.5 | 2.7 | 1.2 | 1.2 | 4.1 | 4.1 | 3.5 | 1.1 | 1.8 | 2.7 |
| 297 B | N | 3.9 | 4.5 | 10.1 | 6.0 | 15.5 | 7.3 | 16.7 | 6.6 | 0 | 5.1 |
| 298 B | S | 1.7 | 2.5 | 3.5 | 2.5 | 2.5 | 3.7 | 2.4 | 3.0 | 0 | 1.8 |
| 299 B | T | 0 | 2.7 | 7.2 | 11.1 | 20 | 4.8 | 20 | 7.5 | 6.9 | 20 |
| 300 B | Y | 3.8 | 5.2 | 8.0 | 4.3 | 20 | 8.6 | 20 | 12.2 | 0 | 4.3 |
| 301 B | R | 1.2 | 1.8 | 2.3 | 1.1 | 20 | 5.8 | 11.3 | 5.2 | 0.3 | 5.0 |
| 302 B | V | 3.5 | 4.8 | 5.5 | 3.7 | 0.2 | 9.6 | 1.1 | 0.5 | 2.6 | 3.5 |
| 303 B | V | 0.2 | 0 | 0.1 | 1.0 | 20 | 5.0 | 13.3 | 5.1 | 1.7 | 10.4 |
| 304 B | S | 1.5 | 2.3 | 8.2 | 20 | 20 | 7.6 | 20 | 7.6 | 20 | 20 |
| 305 B | V | 0.1 | 1.2 | 3.3 | 1.1 | 20 | 4.6 | 20 | 3.2 | 1.1 | 11.0 |
| 306 B | L | 4.7 | 6.8 | 6.3 | 4.3 | 10.4 | 11.1 | 7.8 | 4.2 | 3.0 | 0 |
| 307 B | T | 1.5 | 3.0 | 2.7 | 1.7 | 4.1 | 5.2 | 3.0 | 1.6 | 1.9 | 3.1 |
| 308 B | V | 0 | 0.6 | 7.6 | 20 | 20 | 6.6 | 20 | 20 | 16.1 | 15.1 |
| 309 B | L | 1.4 | 3.0 | 2.2 | 1.1 | 3.0 | 6.0 | 3.5 | 20 | 2.4 | 1.7 |
| 310 B | H | 2.4 | 2.9 | 2.7 | 4.9 | 20 | 6.8 | 4.4 | 4.8 | 3.1 | 15.0 |
| 311 B | Q | 0 | 2.2 | 1.3 | 0.7 | 2.1 | 3.3 | 2.4 | 12.6 | 0.6 | 0.9 |
| 312 B | N | 0 | 1.0 | 0.2 | 0.3 | 6.0 | 5.4 | 2.3 | 12.0 | 2.1 | 2.9 |
| 313 B | W | 5.3 | 6.6 | 7.3 | 5.4 | 0 | 11.4 | 6.2 | 20 | 4.0 | 5.2 |
| 314 B | L | 1.7 | 2.2 | 3.1 | 0 | 6.4 | 5.6 | 1.5 | 2.1 | 0.6 | 0.2 |
| 315 B | D | 1.4 | 2.3 | 2.4 | 0.7 | 6.0 | 5.5 | 2.3 | 4.8 | 2.2 | 1.0 |
| 316 B | G | 50 | 50 | 50 | 50 | 50 | 0 | 50 | 50 | 50 | 50 |
| 317 B | K | 0.9 | 2.3 | 4.3 | 2.8 | 1.2 | 4.0 | 0.6 | 13.9 | 0 | 4.8 |
| 318 B | E | 0.7 | 1.2 | 3.1 | 1.0 | 7.0 | 5.1 | 8.2 | 0.4 | 1.0 | 5.7 |
| 319 B | Y | 6.5 | 7.1 | 8.5 | 8.8 | 0 | 12.5 | 3.9 | 3.1 | 5.2 | 5.4 |
| 320 B | K | 3.1 | 4.3 | 7.3 | 4.3 | 20 | 8.6 | 15.0 | 1.4 | 0 | 11.6 |
| 321 B | C | 0 | 6.5 | 20 | 20 | 20 | 6.6 | 20 | 20 | 20 | 20 |
| 322 B | K | 2.3 | 3.2 | 3.5 | 1.8 | 20 | 7.9 | 20 | 1.1 | 0.6 | 4.9 |
| 323 B | V | 4.0 | 4.6 | 6.9 | 8.1 | 20 | 10.6 | 20 | 9.0 | 17.1 | 7.9 |
| 325 B | N | 3.4 | 5.1 | 9.0 | 4.7 | 20 | 8.2 | 20 | 16.6 | 16.6 | 20 |
| 326 B | K | 0.3 | 2.1 | 2.0 | 0.9 | 1.0 | 3.5 | 2.0 | 2.9 | 0.9 | 2.9 |
| 327 B | A | 1.9 | 3.3 | 4.7 | 3.5 | 20 | 7.0 | 20 | 20 | 0.3 | 0 |
| 328 B | L | 3.7 | 3.6 | 3.8 | 4.4 | 50 | 8.4 | 7.0 | 50 | 3.8 | 0 |
| 329 B | P | 3.3 | 8.5 | 20 | 20 | 50 | 8.0 | 16.5 | 50 | 18.5 | 20 |
| 330 B | A | 0.5 | 2.0 | 2.8 | 0.5 | 2.4 | 3.9 | 1.2 | 4.0 | 0 | 2.0 |
| 331 B | P | 1.7 | 3.8 | 6.4 | 10.1 | 20 | 4.7 | 11.0 | 10.1 | 7.5 | 20 |
| 332 B | I | 1.7 | 2.9 | 1.3 | 1.7 | 14.8 | 7.0 | 13.9 | 1.7 | 3.1 | 0 |
| 333 B | E | 1.9 | 2.5 | 1.9 | 0 | 8.9 | 5.9 | 8.2 | 1.2 | 3.0 | 6.4 |
| 334 B | K | 2.9 | 3.9 | 3.7 | 2.6 | 20 | 8.3 | 12.1 | 1.5 | 2.6 | 5.3 |
| 335 B | T | 0 | 2.1 | 7.2 | 7.0 | 4.2 | 0.4 | 3.3 | 17.3 | 6.5 | 7.7 |
| 336 B | I | 0.5 | 1.6 | 2.1 | 0.7 | 20 | 5.0 | 6.1 | 0 | 1.3 | 5.3 |
| 337 B | S | 1.1 | 2.1 | 4.0 | 2.0 | 3.1 | 3.2 | 2.0 | 50 | 0 | 1.6 |
| 338 B | K | 0.6 | 2.3 | 3.0 | 3.0 | 9.4 | 5.3 | 10.6 | 2.2 | 1.1 | 0 |
| 339 B | A | 1.1 | 2.4 | 1.2 | 0.8 | 4.3 | 3.6 | 3.7 | 2.6 | 1.8 | 2.6 |
| 340 B | K | 0.9 | 2.0 | 1.4 | 0.8 | 3.0 | 3.4 | 2.9 | 2.1 | 0.8 | 2.5 |

| Pos | M | N | P | Q | R | S | T | V | W | Y |
|---|---|---|---|---|---|---|---|---|---|---|
| 235 A | 3.3 | 1.0 | 0.3 | 1.4 | 1.8 | 0 | 1.9 | 3.6 | 6.6 | 3.3 |
| 236 A | 4.9 | 3.3 | 8.2 | 5.6 | 6.0 | 0.8 | 5.6 | 11.8 | 6.6 | 20 |
| 237 A | 20 | 20 | 50 | 50 | 50 | 20 | 20 | 50 | 50 | 50 |
| 238 A | 9.7 | 9.3 | 3.2 | 12.4 | 20 | 8.6 | 50 | 50 | 20 | 8.4 |
| 239 A | 2.1 | 1.8 | 9.1 | 1.3 | 2.5 | 0.3 | 5.7 | 10.7 | 20 | 19.7 |
| 240 A | 5.7 | 2.0 | 1.1 | 9.5 | 13.1 | 2.5 | 0.5 | 0 | 20 | 20 |

TABLE 55-continued

| | | | | | | | | | | |
|---|---|---|---|---|---|---|---|---|---|---|
| 241 A | 2.1 | 0.4 | 14.7 | 0.5 | 1.1 | 0.1 | 0 | 8.3 | 3.6 | 0.4 |
| 242 A | 2.7 | 5.5 | 0.9 | 7.9 | 17.1 | 3.8 | 2.3 | 0 | 20 | 17.5 |
| 243 A | 3.0 | 2.3 | 10.2 | 0.5 | 1.6 | 1.3 | 0.9 | 1.2 | 5.3 | 1.6 |
| 244 A | 2.0 | 2.8 | 2.0 | 0.9 | 1.7 | 0 | 19.3 | 20 | 7.6 | 12.2 |
| 245 A | 20 | 20 | 0 | 20 | 20 | 8.0 | 20 | 50 | 20 | 20 |
| 246 A | 3.1 | 0.2 | 0 | 1.2 | 1.5 | 1.7 | 1.4 | 1.2 | 5.4 | 3.0 |
| 247 A | 3.3 | 0 | 0.5 | 0.9 | 1.5 | 0.7 | 1.1 | 1.3 | 6.9 | 3.7 |
| 248 A | 2.6 | 1.2 | 3.6 | 1.5 | 2.3 | 0.7 | 0 | 2.5 | 5.6 | 2.7 |
| 249 A | 2.2 | 1.4 | 20 | 1.5 | 3.4 | 2.5 | 18.3 | 50 | 20 | 20 |
| 250 A | 0.3 | 3.2 | 50 | 8.7 | 9.3 | 1.8 | 1.3 | 1.9 | 20 | 50 |
| 251 A | 2.4 | 1.4 | 50 | 0 | 1.4 | 0.5 | 0.8 | 6.9 | 8.9 | 5.8 |
| 252 A | 2.2 | 0.3 | 17.4 | 0.1 | 1.1 | 0.1 | 0.2 | 4.6 | 4.2 | 3.3 |
| 253 A | 0.8 | 0.8 | 0.3 | 0 | 1.1 | 0.3 | 0.5 | 2.8 | 2.4 | 1.9 |
| 254 A | 2.4 | 0 | 20 | 0.3 | 1.2 | 0.3 | 0.8 | 0.7 | 3.8 | 1.9 |
| 255 A | 1.5 | 1.7 | 50 | 2.1 | 0 | 2.3 | 50 | 17.2 | 4.0 | 0.5 |
| 256 A | 2.4 | 0 | 0.4 | 0.1 | 0.2 | 0.4 | 0.9 | 1.2 | 5.6 | 2.7 |
| 257 A | 14.4 | 20 | 0.1 | 13.1 | 20 | 2.9 | 16.0 | 20 | 50 | 50 |
| 258 A | 3.2 | 2.9 | 10.4 | 7.4 | 6.0 | 1.0 | 6.2 | 17.6 | 20 | 1.0 |
| 259 A | 6.2 | 4.1 | 50 | 9.2 | 20 | 5.2 | 2.1 | 0 | 20 | 20 |
| 260 A | 2.8 | 1.8 | 1.1 | 0.8 | 0.9 | 1.7 | 0.4 | 1.9 | 7.1 | 20 |
| 261 A | 20 | 20 | 50 | 20 | 20 | 3.6 | 20 | 20 | 20 | 20 |
| 262 A | 2.2 | 0.6 | 50 | 3.8 | 5.2 | 3.4 | 3.0 | 1.7 | 20 | 20 |
| 263 A | 16.9 | 5.2 | 50 | 19.8 | 17.7 | 2.8 | 1.4 | 0 | 20 | 20 |
| 264 A | 2.7 | 2.1 | 2.3 | 2.6 | 2.7 | 2.2 | 1.1 | 0.6 | 3.9 | 0.1 |
| 265 A | 7.5 | 5.5 | 50 | 10.2 | 8.6 | 7.9 | 20 | 50 | 20 | 5.7 |
| 266 A | 8.8 | 7.1 | 50 | 12.2 | 20 | 6.1 | 3.8 | 0 | 20 | 20 |
| 267 A | 3.9 | 4.7 | 0 | 2.3 | 3.1 | 3.0 | 20 | 20 | 50 | 50 |
| 268 A | 2.7 | 1.7 | 0 | 1.4 | 1.7 | 1.1 | 0.2 | 0.9 | 6.1 | 3.7 |
| 269 A | 2.5 | 0 | 50 | 0.6 | 0.8 | 0.2 | 0.6 | 0.7 | 4.0 | 1.0 |
| 270 A | 2.2 | 1.9 | 20 | 1.9 | 1.8 | 1.2 | 1.7 | 4.1 | 5.1 | 7.0 |
| 271 A | 5.3 | 7.3 | 5.9 | 5.9 | 5.9 | 1.6 | 4.1 | 15.2 | 20 | 20 |
| 272 A | 3.2 | 0.3 | 50 | 1.1 | 1.6 | 0 | 1.0 | 3.5 | 4.0 | 3.4 |
| 273 A | 20 | 0 | 2.8 | 20 | 20 | 2.1 | 1.4 | 1.7 | 20 | 20 |
| 274 A | 2.9 | 0.9 | 20 | 0 | 0.1 | 0 | 0.4 | 0.7 | 3.3 | 2.3 |
| 275 A | 6.0 | 9.1 | 6.1 | 9.1 | 15.1 | 9.6 | 7.2 | 6.1 | 13.5 | 4.3 |
| 276 A | 2.5 | 1.8 | 50 | 1.6 | 2.5 | 1.2 | 0 | 0.3 | 4.2 | 3.6 |
| 277 A | 3.6 | 6.6 | 3.5 | 5.5 | 15.4 | 6.9 | 6.1 | 14.1 | 0 | 20 |
| 278 A | 2.1 | 0 | 50 | 1.9 | 2.2 | 2.6 | 9.9 | 20 | 15.8 | 1.4 |
| 279 A | 3.1 | 3.3 | 20 | 1.9 | 4.6 | 4.3 | 3.4 | 4.2 | 20 | 20 |
| 280 A | 2.8 | 3.8 | 50 | 0 | 3.7 | 0.6 | 6.8 | 12.7 | 11.9 | 11.4 |
| 281 A | 50 | 50 | 50 | 50 | 50 | 50 | 50 | 50 | 50 | 50 |
| 282 A | 3.6 | 0.4 | 18.9 | 0.5 | 1.0 | 0 | 0.6 | 0.9 | 4.7 | 3.1 |
| 283 A | 1.9 | 0 | 0.4 | 0.6 | 1.5 | 0.4 | 0.3 | 1.2 | 4.1 | 0.9 |
| 284 A | 0.8 | 2.6 | 50 | 0.8 | 0.7 | 0.8 | 0.1 | 1.5 | 20 | 20 |
| 285 A | 3.0 | 0.7 | 2.2 | 0.2 | 0.8 | 0 | 1.1 | 4.7 | 4.9 | 4.0 |
| 286 A | 1.8 | 0.6 | 20 | 1.2 | 0.7 | 0.9 | 1.7 | 2.1 | 5.2 | 2.7 |
| 287 A | 1.3 | 3.6 | 50 | 2.6 | 2.3 | 1.0 | 1.9 | 12.5 | 9.1 | 10.4 |
| 288 A | 2.5 | 0.3 | 50 | 0.5 | 1.3 | 0 | 0.4 | 2.0 | 4.5 | 3.6 |
| 289 A | 1.6 | 2.1 | 8.2 | 1.2 | 2.0 | 0 | 0.4 | 12.0 | 3.9 | 3.2 |
| 290 A | 3.2 | 0 | 50 | 0.7 | 2.0 | 0.3 | 1.3 | 3.3 | 5.6 | 3.3 |
| 291 A | 1.2 | 1.2 | 0.7 | 0 | 2.9 | 2.2 | 0.9 | 1.3 | 2.6 | 0.9 |
| 292 A | 2.1 | 1.1 | 8.4 | 0.2 | 0.4 | 1.0 | 1.3 | 4.7 | 8.3 | 5.7 |
| 293 A | 10.3 | 7.2 | 5.5 | 15.1 | 14.5 | 3.5 | 20 | 50 | 14.5 | 17.1 |
| 294 A | 2.8 | 1.0 | 50 | 1.3 | 1.3 | 0.5 | 0 | 3.4 | 11.2 | 10.2 |
| 295 A | 50 | 50 | 50 | 50 | 50 | 50 | 50 | 50 | 50 | 50 |
| 296 A | 3.1 | 0.9 | 50 | 0.2 | 1.8 | 1.3 | 4.7 | 4.8 | 18.2 | 20 |
| 297 A | 4.8 | 9.3 | 50 | 4.4 | 4.4 | 1.5 | 1.6 | 15.5 | 20 | 20 |
| 298 A | 1.8 | 3.3 | 50 | 1.7 | 2.1 | 0 | 2.2 | 7.3 | 15.6 | 20 |
| 299 A | 2.6 | 3.6 | 50 | 2.2 | 2.5 | 1.1 | 2.2 | 5.4 | 3.6 | 1.4 |
| 300 A | 2.2 | 2.3 | 50 | 3.3 | 4.0 | 2.6 | 1.1 | 1.1 | 11.0 | 2.4 |
| 301 A | 2.6 | 2.5 | 50 | 2.6 | 2.3 | 2.9 | 1.8 | 0.9 | 9.8 | 1.8 |
| 302 A | 2.2 | 4.8 | 50 | 4.7 | 3.2 | 4.3 | 7.7 | 3.8 | 0 | 8.4 |
| 303 A | 2.0 | 3.1 | 1.0 | 2.1 | 2.9 | 0.4 | 0.4 | 2.9 | 10.9 | 6.2 |
| 304 A | 11.9 | 16.6 | 50 | 20 | 16.6 | 2.2 | 14.2 | 17.9 | 20 | 20 |
| 305 A | 2.8 | 1.1 | 3.9 | 1.1 | 1.4 | 1.2 | 0.9 | 0 | 0.8 | 0.8 |
| 306 A | 3.5 | 6.0 | 50 | 5.9 | 9.9 | 6.2 | 5.3 | 11.4 | 9.6 | 10.3 |
| 307 A | 3.0 | 2.2 | 0 | 1.9 | 1.3 | 1.4 | 0.9 | 1.2 | 6.2 | 6.5 |
| 308 A | 19.4 | 7.6 | 50 | 7.7 | 15.5 | 0 | 0.7 | 5.9 | 50 | 50 |
| 309 A | 2.8 | 0 | 1.6 | 0.7 | 1.3 | 1.0 | 0.6 | 0.5 | 5.0 | 2.1 |
| 310 A | 4.0 | 0 | 0.2 | 4.9 | 10 | 2.0 | 2.5 | 6.4 | 50 | 50 |
| 311 A | 2.9 | 0.9 | 1.7 | 0.8 | 0.9 | 0 | 0.3 | 2.2 | 4.6 | 2.0 |
| 312 A | 3.3 | 7.1 | 50 | 2.7 | 3.9 | 4.1 | 3.2 | 11.9 | 20 | 20 |
| 313 A | 7.6 | 5.4 | 50 | 4.8 | 12.9 | 6.0 | 3.8 | 6.6 | 0 | 2.6 |
| 314 A | 1.7 | 2.3 | 50 | 1.6 | 1.6 | 3.0 | 4.7 | 6.3 | 8.0 | 6.0 |
| 315 A | 1.8 | 0.6 | 50 | 0 | 0.7 | 0 | 0.9 | 2.4 | 6.2 | 3.7 |
| 316 A | 50 | 50 | 50 | 50 | 50 | 50 | 50 | 50 | 50 | 50 |
| 317 A | 12.7 | 20 | 15.9 | 17.2 | 13.5 | 2.8 | 9.2 | 20 | 50 | 50 |
| 318 A | 1.3 | 1.7 | 20 | 1.4 | 2.6 | 2.2 | 1.3 | 0 | 6.1 | 9.5 |
| 319 A | 0.7 | 3.2 | 50 | 3.1 | 5.6 | 3.4 | 3.6 | 20 | 20 | 0.2 |

TABLE 55-continued

| | | | | | | | | | | |
|---|---|---|---|---|---|---|---|---|---|---|
| 320 A | 2.7 | 1.3 | 50 | 2.4 | 1.9 | 3.3 | 3.3 | 7.2 | 20 | 20 |
| 321 A | 10.4 | 20 | 50 | 19.6 | 20 | 1.5 | 8.7 | 18.3 | 20 | 20 |
| 322 A | 2.7 | 2.7 | 50 | 2.1 | 0 | 2.3 | 1.6 | 0.9 | 14.5 | 2.8 |
| 323 A | 4.9 | 8.5 | 50 | 13.6 | 20 | 2.8 | 1.6 | 0 | 20 | 20 |
| 324 A | 1.9 | 0.9 | 50 | 0.8 | 2.9 | 2.7 | 1.9 | 2.1 | 3.8 | 2.5 |
| 325 A | 6.2 | 1.6 | 13.4 | 0.5 | 20 | 3.1 | 0.1 | 1.3 | 20 | 20 |
| 326 A | 3.7 | 1.2 | 0 | 0.6 | 1.4 | 1.0 | 1.9 | 2.6 | 5.6 | 3.6 |
| 327 A | 2.5 | 5.3 | 20 | 1.3 | 4.1 | 0 | 5.2 | 13.7 | 20 | 20 |
| 328 A | 7.1 | 6.0 | 50 | 3.7 | 8.2 | 6.6 | 50 | 50 | 20 | 50 |
| 329 A | 3.6 | 0 | 0.3 | 0.7 | 1.5 | 0.1 | 1.1 | 1.1 | 6.2 | 3.6 |
| 330 A | 3.4 | 0 | 20 | 0.6 | 1.2 | 0.2 | 0.6 | 1.9 | 7.0 | 3.4 |
| 331 A | 50 | 50 | 50 | 50 | 50 | 50 | 50 | 50 | 50 | 50 |
| 332 A | 2.5 | 3.9 | 20 | 0.8 | 2.4 | 2.3 | 2.6 | 4.4 | 20 | 5.9 |
| 333 A | 2.8 | 2.5 | 1.6 | 1.3 | 3.2 | 1.3 | 1.4 | 7.7 | 4.0 | 4.8 |
| 334 A | 3.5 | 1.5 | 4.4 | 0.1 | 2.7 | 2.2 | 0.9 | 1.3 | 4.9 | 1.8 |
| 335 A | 3.0 | 1.2 | 0 | 2.3 | 2.8 | 1.4 | 1.4 | 7.3 | 5.1 | 4.5 |
| 336 A | 2.5 | 3.2 | 20 | 2.8 | 1.4 | 0.7 | 0.6 | 0 | 20 | 20 |
| 337 A | 7.9 | 5.0 | 50 | 11.4 | 12.7 | 4.5 | 2.3 | 50 | 19.3 | 10.6 |
| 338 A | 1.9 | 1.0 | 50 | 1.5 | 0.9 | 0.7 | 10.3 | 50 | 5.4 | 4.9 |
| 339 A | 3.6 | 0 | 0.8 | 0.6 | 1.6 | 0.6 | 0.9 | 2.4 | 6.8 | 3.8 |
| 340 A | 1.8 | 1.0 | 1.9 | 0.9 | 1.3 | 0.5 | 0.8 | 1.7 | 4.9 | 2.4 |
| 232 B | 3.9 | 1.1 | 0 | 1.1 | 1.6 | 0.7 | 1.4 | 3.0 | 6.2 | 4.1 |
| 233 B | 3.2 | 0.6 | 2.7 | 0.4 | 1.6 | 0 | 1.2 | 6.9 | 5.5 | 2.6 |
| 234 B | 2.7 | 2.6 | 20 | 3.6 | 1.2 | 3.1 | 2.5 | 3.4 | 13.4 | 0.5 |
| 235 B | 1.9 | 1.9 | 17.3 | 0.6 | 1.4 | 0.8 | 0.7 | 5.2 | 7.8 | 5.3 |
| 236 B | 4.5 | 3.5 | 50 | 5.5 | 19.9 | 2.6 | 20 | 20 | 20 | 14.1 |
| 237 B | 50 | 50 | 50 | 50 | 50 | 50 | 50 | 50 | 50 | 50 |
| 238 B | 4.6 | 8.1 | 1.3 | 5.8 | 20 | 4.9 | 4.4 | 1.3 | 20 | 20 |
| 239 B | 2.0 | 1.9 | 50 | 1.7 | 1.1 | 1.5 | 1.5 | 5.2 | 20 | 5.2 |
| 240 B | 12.0 | 7.6 | 0 | 11.6 | 20 | 1.2 | 1.9 | 0.8 | 20 | 20 |
| 241 B | 2.3 | 0.2 | 50 | 0.3 | 1.5 | 0.1 | 0.9 | 5.7 | 4.1 | 1.1 |
| 242 B | 4.8 | 5.3 | 0 | 9.1 | 6.8 | 2.9 | 1.1 | 0.5 | 20 | 8.7 |
| 243 B | 2.5 | 0 | 50 | 1.6 | 2.7 | 0.1 | 1.8 | 3.9 | 4.3 | 1.0 |
| 244 B | 3.0 | 2.0 | 1.8 | 1.2 | 1.3 | 0 | 19.6 | 20 | 9.1 | 11.0 |
| 245 B | 20 | 20 | 0 | 20 | 20 | 6.0 | 20 | 50 | 20 | 20 |
| 246 B | 2.5 | 0.2 | 0.3 | 0.2 | 0.3 | 0.1 | 0 | 2.0 | 4.9 | 2.4 |
| 247 B | 2.9 | 0.3 | 0 | 0.8 | 1.5 | 0.3 | 0.7 | 9.5 | 6.6 | 3.4 |
| 248 B | 2.2 | 0 | 1.3 | 0.8 | 1.7 | 0.5 | 0.7 | 2.8 | 4.7 | 2.3 |
| 249 B | 4.4 | 0.5 | 50 | 4.7 | 6.3 | 3.5 | 6.1 | 50 | 20 | 7.2 |
| 250 B | 3.0 | 9.2 | 50 | 3.4 | 4.9 | 1.3 | 2.3 | 3.1 | 20 | 20 |
| 251 B | 2.3 | 0.5 | 50 | 0.6 | 1.8 | 0.4 | 2.5 | 8.7 | 8.2 | 5.9 |
| 252 B | 2.5 | 1.0 | 50 | 1.0 | 1.6 | 1.5 | 1.3 | 0.8 | 5.1 | 1.6 |
| 253 B | 2.4 | 1.1 | 1.0 | 0 | 1.5 | 1.2 | 1.4 | 3.4 | 4.4 | 3.6 |
| 254 B | 3.1 | 0.3 | 6.2 | 0.5 | 1.7 | 0 | 0.1 | 1.1 | 5.5 | 3.7 |
| 255 B | 1.3 | 0.8 | 50 | 1.4 | 1.1 | 1.5 | 20 | 20 | 3.7 | 0.8 |
| 256 B | 2.2 | 0 | 1.2 | 0.5 | 0.1 | 0.8 | 1.2 | 1.2 | 5.5 | 2.4 |
| 257 B | 20 | 20 | 0 | 20 | 20 | 4.8 | 20 | 20 | 50 | 50 |
| 258 B | 2.4 | 1.1 | 50 | 1.3 | 2.5 | 2.2 | 1.1 | 1.0 | 19.1 | 3.0 |
| 259 B | 5.5 | 5.6 | 50 | 6.2 | 20 | 4.5 | 2.5 | 0 | 20 | 20 |
| 260 B | 1.4 | 3.9 | 0.2 | 2.3 | 2.6 | 0.4 | 0.1 | 2.7 | 20 | 20 |
| 261 B | 20 | 20 | 20 | 20 | 20 | 2.0 | 16.6 | 20 | 20 | 20 |
| 262 B | 3.4 | 2.7 | 50 | 3.2 | 4.8 | 2.9 | 1.9 | 0 | 14.7 | 9.1 |
| 263 B | 20 | 5.4 | 50 | 13.0 | 20 | 3.6 | 2.1 | 0 | 20 | 20 |
| 264 B | 3.7 | 3.6 | 10.1 | 3.0 | 2.2 | 2.6 | 2.2 | 1.0 | 12.7 | 20 |
| 265 B | 4.1 | 1.8 | 50 | 4.5 | 5.3 | 4.5 | 6.0 | 9.2 | 12.2 | 5.6 |
| 266 B | 20 | 5.7 | 50 | 18.3 | 20 | 5.9 | 4.7 | 0 | 50 | 50 |
| 267 B | 3.2 | 3.2 | 0.5 | 1.5 | 0.8 | 3.3 | 11.6 | 50 | 6.3 | 50 |
| 268 B | 3.8 | 2.6 | 3.4 | 2.1 | 1.8 | 2.5 | 3.8 | 2.7 | 7.8 | 5.5 |
| 269 B | 3.0 | 0 | 12.8 | 0.5 | 0.7 | 0.3 | 0.7 | 0.6 | 5.1 | 2.7 |
| 270 B | 3.8 | 1.2 | 5.9 | 6.3 | 2.1 | 0.3 | 1.9 | 5.4 | 16.3 | 5.6 |
| 271 B | 3.9 | 3.3 | 7.4 | 2.7 | 0 | 1.5 | 2.2 | 5.2 | 4.8 | 4.4 |
| 272 B | 3.5 | 0.6 | 4.9 | 0 | 1.4 | 0.2 | 0.6 | 1.4 | 3.9 | 3.2 |
| 273 B | 3.5 | 7.4 | 50 | 10.6 | 20 | 2.0 | 0 | 4.8 | 20 | 20 |
| 274 B | 2.4 | 0.3 | 15.6 | 0.1 | 0 | 0 | 0.2 | 1.6 | 2.2 | 1.9 |
| 275 B | 5.1 | 7.0 | 4.1 | 9.7 | 12.3 | 6.9 | 4.5 | 3.3 | 10.3 | 5.0 |
| 276 B | 7.4 | 3.8 | 50 | 6.4 | 9.2 | 2.8 | 20 | 20 | 20 | 20 |
| 277 B | 6.4 | 10.8 | 6.8 | 9.3 | 11.9 | 9.7 | 8.0 | 14.4 | 0 | 15.9 |
| 278 B | 2.1 | 12.6 | 11.0 | 4.4 | 2.0 | 0.8 | 2.5 | 19.8 | 20 | 4.2 |
| 279 B | 2.0 | 3.4 | 20 | 1.4 | 4.0 | 4.2 | 2.4 | 1.2 | 20 | 20 |
| 280 B | 2.9 | 1.6 | 20 | 1.4 | 3.1 | 0 | 2.7 | 5.5 | 8.1 | 7.3 |
| 281 B | 7.1 | 3.4 | 50 | 4.0 | 5.3 | 3.6 | 3.2 | 6.4 | 10.3 | 7.6 |
| 282 B | 2.9 | 0.2 | 50 | 0 | 0.7 | 0 | 0.4 | 0.7 | 6.1 | 2.8 |
| 283 B | 0.3 | 2.5 | 0 | 1.5 | 1.6 | 1.0 | 1.5 | 3.9 | 7.9 | 6.7 |
| 284 B | 0.8 | 2.4 | 50 | 1.5 | 3.3 | 0 | 1.5 | 1.8 | 20 | 20 |
| 285 B | 2.7 | 0 | 1.6 | 0.9 | 0.8 | 0.5 | 0.4 | 2.0 | 5.8 | 2.4 |
| 286 B | 2.9 | 0 | 50 | 0.4 | 1.6 | 1.1 | 0.5 | 2.9 | 4.9 | 3.0 |
| 287 B | 4.5 | 0.3 | 12.3 | 8.1 | 9.1 | 4.1 | 3.3 | 7.1 | 3.4 | 0.8 |
| 288 B | 2.5 | 0.9 | 15.4 | 0.6 | 1.1 | 0.2 | 0.9 | 3.8 | 5.9 | 2.7 |
| 289 B | 1.6 | 1.5 | 1.8 | 1.1 | 1.7 | 0 | 0.4 | 2.3 | 3.4 | 2.5 |

TABLE 55-continued

| | | | | | | | | | | |
|---|---|---|---|---|---|---|---|---|---|---|
| 290 B | 2.6 | 0.2 | 50 | 0.7 | 1.5 | 0 | 0.6 | 2.9 | 5.0 | 2.7 |
| 291 B | 1.5 | 1.1 | 0.6 | 0.1 | 1.1 | 1.1 | 0.9 | 1.5 | 3.2 | 2.6 |
| 292 B | 2.2 | 2.2 | 16.6 | 1.5 | 1.8 | 0.1 | 0 | 3.2 | 7.6 | 5.2 |
| 293 B | 3.2 | 2.2 | 1.3 | 2.2 | 2.5 | 0 | 1.2 | 7.8 | 7.0 | 6.9 |
| 294 B | 3.7 | 4.1 | 0 | 3.3 | 5.0 | 2.1 | 2.9 | 5.0 | 6.7 | 11.9 |
| 295 B | 3.4 | 1.0 | 0.4 | 0.4 | 1.1 | 0 | 3.9 | 6.6 | 6.1 | 3.5 |
| 296 B | 3.5 | 0 | 20 | 0.6 | 1.9 | 1.2 | 1.4 | 1.3 | 6.4 | 4.0 |
| 297 B | 4.6 | 7.3 | 20 | 4.4 | 4.2 | 3.6 | 4.1 | 7.9 | 18.0 | 15.0 |
| 298 B | 2.3 | 0.4 | 50 | 1.2 | 1.0 | 0.9 | 2.2 | 3.3 | 5.5 | 2.0 |
| 299 B | 7.1 | 4.8 | 50 | 9.8 | 17.9 | 0.3 | 1.3 | 5.8 | 20 | 20 |
| 300 B | 3.2 | 6.5 | 50 | 4.0 | 3.8 | 4.3 | 3.6 | 9.1 | 20 | 6.4 |
| 301 B | 2.0 | 1.6 | 14.1 | 0.6 | 0.4 | 1.8 | 1.1 | 0 | 17.9 | 20 |
| 302 B | 2.5 | 4.7 | 9.6 | 4.1 | 0.6 | 4.3 | 2.0 | 0 | 20 | 0.2 |
| 303 B | 1.9 | 2.0 | 8.6 | 2.0 | 4.7 | 0.6 | 0.5 | 1.3 | 20 | 20 |
| 304 B | 20 | 6.3 | 50 | 20 | 20 | 0 | 2.7 | 3.8 | 20 | 20 |
| 305 B | 1.5 | 1.8 | 50 | 0.6 | 2.0 | 0.6 | 0 | 0.7 | 20 | 20 |
| 306 B | 3.8 | 5.7 | 13.4 | 4.4 | 14.1 | 5.5 | 4.3 | 6.0 | 20 | 12.1 |
| 307 B | 3.4 | 1.7 | 0 | 1.7 | 1.9 | 1.5 | 1.4 | 2.0 | 4.4 | 4.3 |
| 308 B | 20 | 12.4 | 50 | 20 | 20 | 1.2 | 3.6 | 4.3 | 20 | 20 |
| 309 B | 3.6 | 0.2 | 0 | 1.6 | 2.3 | 1.8 | 14.3 | 20 | 5.1 | 3.3 |
| 310 B | 3.4 | 0 | 2.3 | 4.6 | 7.0 | 1.8 | 1.6 | 3.8 | 20 | 20 |
| 311 B | 2.3 | 0.6 | 3.2 | 0.4 | 0.8 | 0.2 | 1.6 | 18.8 | 4.6 | 2.0 |
| 312 B | 1.6 | 0.9 | 50 | 1.3 | 5.7 | 0.1 | 5.6 | 3.8 | 8.0 | 7.8 |
| 313 B | 4.3 | 8.0 | 50 | 6.5 | 8.9 | 6.6 | 17.2 | 20 | 2.1 | 0.9 |
| 314 B | 1.1 | 1.9 | 50 | 0.8 | 1.0 | 1.7 | 0.9 | 3.1 | 3.7 | 11.3 |
| 315 B | 2.9 | 1.8 | 50 | 1.0 | 2.2 | 0.2 | 0 | 4.5 | 8.5 | 6.8 |
| 316 B | 50 | 50 | 50 | 50 | 50 | 50 | 50 | 50 | 50 | 50 |
| 317 B | 1.6 | 1.3 | 50 | 4.2 | 0.9 | 0.4 | 13.8 | 10.1 | 20 | 1.7 |
| 318 B | 1.7 | 2.3 | 3.8 | 1.0 | 1.6 | 0.4 | 0 | 1.0 | 3.8 | 7.7 |
| 319 B | 8.4 | 7.2 | 50 | 9.0 | 13.7 | 7.2 | 5.8 | 3.9 | 20 | 1.7 |
| 320 B | 3.6 | 6.6 | 50 | 2.9 | 2.4 | 4.0 | 3.3 | 2.0 | 20 | 20 |
| 321 B | 20 | 20 | 19.7 | 20 | 20 | 3.1 | 11.2 | 20 | 20 | 20 |
| 322 B | 3.7 | 2.2 | 50 | 0.9 | 0.3 | 3.3 | 1.6 | 0 | 20 | 20 |
| 323 B | 8.1 | 10.5 | 50 | 8.7 | 20 | 5.6 | 4.6 | 0 | 20 | 20 |
| 325 B | 20 | 0 | 50 | 6.3 | 20 | 4.6 | 8.8 | 17.8 | 20 | 20 |
| 326 B | 2.8 | 0.1 | 4.4 | 0 | 1.1 | 0.1 | 3.2 | 2.1 | 5.2 | 0.7 |
| 327 B | 1.9 | 1.9 | 20 | 3.0 | 2.3 | 3.3 | 20 | 20 | 20 | 20 |
| 328 B | 2.6 | 4.0 | 50 | 4.2 | 8.7 | 4.8 | 2.9 | 12.3 | 50 | 50 |
| 329 B | 14.7 | 20 | 0 | 20 | 20 | 1.4 | 17.1 | 16.4 | 50 | 50 |
| 330 B | 2.1 | 0.8 | 20 | 0 | 0.5 | 0.8 | 0.2 | 4.6 | 8.2 | 2.6 |
| 331 B | 5.5 | 5.0 | 0 | 7.6 | 7.4 | 2.6 | 20 | 10.1 | 17.6 | 20 |
| 332 B | 1.7 | 1.7 | 50 | 1.8 | 5.3 | 2.0 | 1.9 | 3.4 | 20 | 20 |
| 333 B | 3.4 | 2.0 | 3.1 | 1.1 | 2.3 | 1.8 | 1.6 | 1.6 | 8.9 | 9.3 |
| 334 B | 3.7 | 4.3 | 50 | 1.9 | 0 | 3.4 | 1.8 | 1.4 | 9.9 | 20 |
| 335 B | 5.2 | 5.5 | 3.5 | 7.0 | 5.7 | 0.2 | 5.5 | 11.5 | 5.2 | 3.1 |
| 336 B | 2.1 | 1.8 | 20 | 0.6 | 3.1 | 1.1 | 0.8 | 0.7 | 19.4 | 20 |
| 337 B | 0.9 | 1.9 | 15.8 | 1.1 | 2.2 | 1.4 | 50 | 50 | 5.5 | 3.9 |
| 338 B | 3.2 | 1.5 | 16.2 | 2.7 | 2.7 | 1.1 | 2.8 | 3.5 | 8.1 | 11.0 |
| 339 B | 3.5 | 0 | 2.3 | 0.5 | 1.3 | 0.2 | 0.8 | 2.0 | 6.7 | 3.8 |
| 340 B | 2.3 | 0.2 | 1.0 | 0.1 | 1.2 | 0 | 0.5 | 2.0 | 5.5 | 3.2 |

SPA ™ technology; 1IIS template structure; −carbohydrate, no floated positions

TABLE 56

| Pos | WT | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 239 A | S | 0.2 | 4.6 | 2.7 | 0 | 20 | 4.6 | 14.5 | 11.0 | 1.9 | 0.3 | 2.0 | 1.9 | 8.1 | 1.4 | 2.6 | 0.4 | 5.7 | 11.6 | 20 | 20 |
| 240 A | V | 1.5 | 2.4 | 2.4 | 6.9 | 20 | 7.4 | 20 | 5.1 | 9.9 | 5.9 | 5.5 | 2.4 | 1.1 | 12.3 | 13.1 | 2.6 | 0.5 | 0 | 20 | 20 |
| 263 A | V | 2.3 | 2.8 | 6.3 | 16.5 | 20 | 20 | 20 | 9.6 | 7.3 | 7.3 | 15.3 | 4.8 | 50 | 16.4 | 17.4 | 2.8 | 1.4 | 0 | 20 | 20 |
| 264 A | V | 1.8 | 3.1 | 2.6 | 1.8 | 0 | 6.3 | 1.9 | 0.6 | 2.4 | 0.8 | 2.7 | 2.1 | 1.6 | 2.3 | 2.7 | 2.3 | 1.1 | 0.5 | 3.5 | 0 |
| 266 A | V | 4.9 | 5.2 | 6.9 | 12.3 | 20 | 11.1 | 20 | 0.8 | 11.9 | 20 | 8.5 | 6.6 | 50 | 12.5 | 20 | 6.1 | 3.7 | 0 | 20 | 20 |
| 296 A | Y | 3.4 | 2.7 | 1.1 | 0 | 50 | 0.7 | 50 | 5.0 | 3.6 | 3.5 | 4.2 | 0.9 | 50 | 0.9 | 2.9 | 2.2 | 5.3 | 5.5 | 16.1 | 18.4 |
| 299 A | T | 0.7 | 3.2 | 9.9 | 10.4 | 20 | 6.2 | 20 | 10.7 | 6.7 | 20 | 4.1 | 12.9 | 50 | 5.9 | 11.8 | 0 | 2.5 | 8.2 | 13.3 | 20 |
| 325 A | N | 2.5 | 3.5 | 7.7 | 2.5 | 20 | 8.0 | 20 | 0 | 6.1 | 20 | 7.8 | 1.2 | 12.8 | 0.8 | 20 | 2.7 | 0 | 1.0 | 20 | 20 |
| 328 A | L | 6.1 | 6.3 | 7.1 | 4.2 | 50 | 8.8 | 20 | 50 | 4.6 | 0 | 7.2 | 6.1 | 50 | 4.0 | 8.3 | 6.7 | 50 | 50 | 20 | 50 |
| 330 A | A | 0.9 | 1.8 | 1.2 | 0 | 2.5 | 4.0 | 2.9 | 1.7 | 1.2 | 1.6 | 2.8 | 0 | 20 | 0.4 | 1.0 | 0.2 | 0.5 | 1.7 | 6.2 | 2.9 |
| 332 A | I | 1.9 | 3.8 | 4.6 | 1.3 | 5.1 | 7.1 | 1.8 | 3.4 | 0.2 | 0 | 2.6 | 3.8 | 20 | 0.6 | 2.4 | 2.3 | 2.5 | 4.2 | 20 | 5.6 |
| 239 B | S | 1.0 | 2.4 | 3.5 | 2.0 | 6.7 | 5.6 | 2.9 | 3.1 | 0.3 | 0 | 1.9 | 2.1 | 50 | 1.5 | 1.8 | 1.4 | 1.4 | 5.2 | 20 | 4.2 |
| 240 B | V | 0.3 | 2.4 | 6.9 | 11.7 | 20 | 6.6 | 20 | 8.3 | 12.3 | 20 | 14.2 | 7.4 | 0 | 13.4 | 20 | 1.3 | 1.9 | 0.9 | 20 | 20 |
| 263 B | V | 2.4 | 3.9 | 4.5 | 12.5 | 20 | 9.3 | 20 | 15.8 | 17.1 | 2.1 | 20 | 5.3 | 50 | 13.8 | 20 | 3.9 | 2.2 | 0 | 20 | 20 |
| 264 B | V | 2.2 | 3.2 | 4.8 | 2.7 | 7.4 | 6.9 | 6.0 | 0 | 1.9 | 1.9 | 3.8 | 3.7 | 9.9 | 3.1 | 2.2 | 2.7 | 2.4 | 0.9 | 14.7 | 18.2 |
| 266 B | V | 5.4 | 5.5 | 7.5 | 13.2 | 20 | 12.1 | 20 | 2.6 | 20 | 20 | 5.4 | 20 | 16.1 | 20 | 6.0 | 4.7 | 0 | 50 | 50 |
| 296 B | Y | 1.5 | 2.7 | 1.3 | 1.2 | 4.0 | 4.1 | 3.6 | 1.1 | 1.9 | 2.6 | 3.5 | 0 | 20 | 0.7 | 1.8 | 1.1 | 1.4 | 1.3 | 6.5 | 4.2 |
| 299 B | T | 0 | 2.2 | 7.5 | 10.2 | 20 | 4.8 | 20 | 7.7 | 5.8 | 20 | 10.3 | 5.1 | 50 | 10.2 | 18.4 | 0.3 | 1.1 | 5.4 | 20 | 20 |
| 325 B | N | 3.4 | 5.1 | 8.6 | 5.0 | 20 | 8.2 | 20 | 16.7 | 20 | 20 | 20 | 0 | 19.7 | 6.3 | 20 | 4.6 | 8.6 | 18.2 | 20 | 20 |
| 328 B | L | 3.6 | 3.5 | 3.8 | 3.9 | 50 | 8.3 | 7.0 | 50 | 2.9 | 0 | 1.9 | 3.8 | 50 | 3.4 | 8.4 | 4.7 | 2.9 | 12.5 | 50 | 50 |

TABLE 56-continued

| Pos | WT | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 330 B | A | 0.7 | 2.1 | 2.9 | 0.7 | 2.7 | 4.0 | 1.4 | 4.8 | 0 | 2.2 | 2.3 | 0.8 | 20 | 0.2 | 0.8 | 1.1 | 0.2 | 4.7 | 7.8 | 3.2 |
| 332 B | I | 1.8 | 2.9 | 1.2 | 1.8 | 13.5 | 7.0 | 9.9 | 1.7 | 3.2 | 0 | 1.7 | 1.9 | 50 | 1.2 | 5.4 | 2.0 | 2.0 | 3.3 | 20 | 20 |

SPA ™ technology; D129G 1IIS template structure; +carbohydrate

TABLE 57

| Pos | WT | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 239 A | S | 1.2 | 3.5 | 1.7 | 0 | 20 | 5.8 | 11.0 | 6.6 | 2.9 | 3.9 | 3.9 | 2.7 | 8.5 | 1.3 | 2.7 | 0.6 | 3.5 | 5.4 | 20 | 20 |
| 240 A | V | 1.2 | 2.4 | 6.0 | 14.0 | 20 | 7.1 | 20 | 6.7 | 9.4 | 10.1 | 7.5 | 4.4 | 1.8 | 14.8 | 20 | 2.0 | 0.4 | 0 | 20 | 20 |
| 263 A | V | 0 | 0.4 | 1.0 | 8.7 | 20 | 6.9 | 4.4 | 11.7 | 4.9 | 16.0 | 19.2 | 0.8 | 50 | 11.7 | 20 | 1.4 | 0.1 | 1.0 | 20 | 20 |
| 264 A | V | 2.9 | 3.7 | 6.3 | 2.8 | 11.6 | 7.6 | 13.2 | 0 | 3.2 | 3.4 | 4.1 | 4.2 | 7.1 | 2.9 | 3.4 | 3.1 | 1.9 | 0.8 | 12.8 | 16.3 |
| 266 A | V | 4.8 | 5.9 | 6.8 | 9.5 | 50 | 10.3 | 20 | 3.5 | 12.7 | 12.2 | 12.7 | 4.1 | 50 | 11.9 | 11.9 | 5.2 | 2.9 | 0 | 50 | 50 |
| 296 A | Y | 0.8 | 2.0 | 1.5 | 0.1 | 0.2 | 3.4 | 1.5 | 6.6 | 1.7 | 0.6 | 1.8 | 1.2 | 2.6 | 0 | 1.6 | 0.2 | 2.5 | 5.6 | 3.8 | 0 |
| 299 A | T | 1.9 | 3.7 | 7.5 | 0 | 20 | 7.9 | 14.2 | 2.9 | 0.8 | 3.4 | 4.4 | 2.3 | 50 | 1.9 | 3.0 | 3.5 | 4.1 | 3.3 | 20 | 20 |
| 325 A | N | 1.0 | 1.4 | 3.1 | 2.8 | 20 | 7.4 | 20 | 8.5 | 7.7 | 10.4 | 6.1 | 2.8 | 15.4 | 5.4 | 20 | 0 | 0.1 | 3.8 | 20 | 20 |
| 328 A | L | 2.5 | 5.3 | 4.0 | 1.9 | 50 | 7.5 | 20 | 20 | 1.6 | 0.2 | 2.9 | 50 | 0.4 | 4.8 | 3.2 | 2.9 | 7.0 | 50 | 50 |
| 330 A | A | 0.9 | 2.1 | 1.8 | 1.2 | 2.4 | 2.7 | 3.1 | 3.1 | 1.4 | 2.1 | 3.5 | 0.5 | 20 | 0.8 | 1.0 | 0 | 0.5 | 2.9 | 5.2 | 2.9 |
| 332 A | I | 2.9 | 3.7 | 3.9 | 0.9 | 6.1 | 7.8 | 2.5 | 0 | 2.7 | 0.8 | 2.8 | 3.5 | 50 | 0.7 | 3.7 | 2.9 | 2.5 | 1.0 | 8.1 | 6.9 |
| 239 B | S | 1.9 | 3.1 | 3.0 | 1.9 | 1.5 | 6.2 | 2.3 | 14.1 | 1.8 | 1.4 | 2.9 | 1.8 | 0 | 1.9 | 3.2 | 1.9 | 2.3 | 7.7 | 6.6 | 15.8 |
| 240 B | V | 0.5 | 1.7 | 5.0 | 13.3 | 20 | 6.6 | 20 | 1.2 | 12.4 | 12.1 | 8.8 | 4.6 | 6.3 | 20 | 20 | 1.0 | 0.2 | 0 | 20 | 20 |
| 263 B | V | 2.9 | 3.2 | 6.4 | 18.2 | 10.1 | 9.2 | 6.9 | 12.8 | 6.0 | 20 | 10.3 | 5.7 | 50 | 17.5 | 20 | 3.2 | 2.2 | 0 | 20 | 20 |
| 264 B | V | 2.9 | 3.6 | 4.4 | 3.0 | 8.8 | 7.1 | 6.2 | 0 | 2.3 | 1.9 | 4.5 | 3.4 | 1.7 | 3.2 | 3.5 | 3.5 | 2.0 | 0.9 | 12.0 | 16.4 |
| 266 B | V | 4.4 | 4.6 | 2.6 | 6.6 | 20 | 10.7 | 20 | 0 | 4.9 | 1.7 | 8.5 | 5.6 | 50 | 6.0 | 12.4 | 5.3 | 4.6 | 1.5 | 20 | 50 |
| 296 B | Y | 0 | 7.1 | 6.7 | 7.2 | 20 | 0.1 | 18.6 | 50 | 7.0 | 2.7 | 6.6 | 6.8 | 50 | 7.2 | 9.3 | 2.3 | 50 | 50 | 20 | 14.1 |
| 299 B | T | 0 | 3.2 | 10.4 | 6.0 | 20 | 5.5 | 20 | 15.9 | 3.2 | 5.9 | 4.4 | 6.4 | 50 | 5.7 | 9.4 | 1.2 | 1.4 | 13.7 | 20 | 20 |
| 325 B | N | 1.4 | 2.5 | 5.0 | 0 | 20 | 7.0 | 20 | 20 | 1.0 | 2.2 | 1.0 | 0.3 | 1.9 | 1.1 | 20 | 2.6 | 5.1 | 20 | 20 | 20 |
| 328 B | L | 0.4 | 1.3 | 5.6 | 0 | 50 | 4.5 | 50 | 50 | 1.9 | 2.4 | 2.4 | 8.3 | 50 | 0.8 | 16.4 | 1.0 | 1.2 | 50 | 50 | 50 |
| 330 B | A | 0.6 | 1.4 | 2.5 | 0.9 | 3.1 | 2.5 | 1.2 | 20 | 0 | 2.4 | 2.1 | 0.3 | 20 | 0.4 | 0.6 | 0 | 4.0 | 20 | 13.5 | 3.4 |
| 332 B | I | 4.3 | 5.3 | 5.7 | 0 | 11.4 | 9.3 | 4.3 | 2.5 | 5.8 | 2.0 | 4.0 | 6.5 | 17.9 | 3.7 | 5.9 | 4.6 | 4.2 | 3.7 | 20 | 11.6 |

SPA ™ technology; D129G 1IIX template structure; +carbohydrate

TABLE 58

| Pos | WT | A | C | D | E | F | G | H | I | K | L | M |
|---|---|---|---|---|---|---|---|---|---|---|---|---|
| 239 A | S | 1.2 | 2.3 | 2.2 | 1.8 | 7.9 | 5.5 | 7.6 | 0.5 | 0.2 | 1.8 | 2.6 |
| 240 A | V | 0.7 | 2.9 | 6.8 | 4.3 | 20 | 6.5 | 20 | 0 | 10.7 | 20 | 3.1 |
| 263 A | V | 1.7 | 2.9 | 4.6 | 18.8 | 20 | 8.4 | 5.8 | 15.1 | 2.3 | 14.5 | 2.1 |
| 264 A | V | 2.7 | 3.3 | 3.6 | 1.5 | 13.9 | 6.7 | 5.9 | 0 | 2.3 | 4.9 | 3.7 |
| 266 A | V | 3.5 | 3.5 | 5.7 | 12.4 | 20 | 10 | 20 | 5.7 | 6.3 | 7.8 | 7.4 |
| 296 A | Y | 2.6 | 50 | 50 | 50 | 50 | 0 | 50 | 50 | 18.5 | 18.0 | 50 |
| 299 A | T | 0.2 | 0.7 | 6.6 | 1.2 | 20 | 5.6 | 9.6 | 1.6 | 0.8 | 1.5 | 1.8 |
| 325 A | N | 3.1 | 3.6 | 7.3 | 2.4 | 20 | 7.7 | 20 | 20 | 20 | 10 | 13.1 |
| 328 A | L | 0.6 | 0 | 1.5 | 5.4 | 50 | 1.6 | 50 | 50 | 3.1 | 4.2 | 9.6 |
| 330 A | A | 1.9 | 2.5 | 4.1 | 2.8 | 4.5 | 4.1 | 3.0 | 3.2 | 1.0 | 2.7 | 3.5 |
| 332 A | I | 2.3 | 3.5 | 2.2 | 0.8 | 20 | 6.8 | 9.6 | 0 | 3.4 | 0.2 | 1.6 |
| 239 B | S | 1.4 | 3.6 | 2.5 | 1.4 | 16.8 | 5.8 | 6.2 | 5.0 | 2.5 | 1.4 | 2.0 |
| 240 B | V | 0 | 2.6 | 12.8 | 18.6 | 20 | 5.7 | 20 | 12.7 | 10.4 | 20 | 8.5 |
| 263 B | V | 1.1 | 2.4 | 3.6 | 20 | 20 | 7.8 | 17.7 | 11.8 | 4.5 | 20 | 6.3 |
| 264 B | V | 3.3 | 4.0 | 5.0 | 2.9 | 14.2 | 7.5 | 4.8 | 0 | 2.6 | 3.6 | 4.6 |
| 266 B | V | 2.9 | 3.3 | 4.9 | 11.3 | 50 | 9.5 | 20 | 20 | 20 | 7.9 | 15.0 |
| 296 B | Y | 2.8 | 50 | 50 | 50 | 50 | 0 | 50 | 50 | 17.7 | 18.7 | 50 |
| 299 B | T | 0 | 3.8 | 12.6 | 9.2 | 20 | 5.9 | 20 | 7.3 | 4.8 | 3.2 | 4.3 |
| 325 B | N | 0.3 | 2.0 | 5.5 | 2.2 | 50 | 6.1 | 20 | 0 | 10.5 | 15.5 | 14.6 |
| 328 B | L | 5.4 | 5.7 | 7.3 | 4.4 | 50 | 9.8 | 20 | 50 | 2.5 | 0 | 5.1 |
| 330 B | A | 0.6 | 1.4 | 3.2 | 1.3 | 3.9 | 3.2 | 2.7 | 4.0 | 1.3 | 3.7 | 3.1 |
| 332 B | I | 1.9 | 3.1 | 2.7 | 1.7 | 5.2 | 6.9 | 3.1 | 0.4 | 1.3 | 0 | 1.9 |

| Pos | N | P | Q | R | S | T | V | W | Y |
|---|---|---|---|---|---|---|---|---|---|
| 239 A | 1.4 | 0.9 | 1.3 | 1.9 | 1.5 | 0.8 | 0 | 8.6 | 9.6 |
| 240 A | 9.1 | 2.1 | 7.7 | 20 | 1.4 | 1.1 | 2.4 | 20 | 20 |
| 263 A | 3.2 | 50 | 20 | 15.0 | 3.6 | 1.2 | 0 | 20 | 20 |
| 264 A | 3.2 | 1.9 | 2.5 | 3.0 | 3.0 | 2.5 | 0.7 | 19.9 | 19.0 |
| 266 A | 5.2 | 50 | 16.6 | 20 | 4.2 | 1.7 | 0 | 20 | 50 |
| 296 A | 50 | 50 | 50 | 50 | 50 | 50 | 50 | 50 | 13.6 |
| 299 A | 4.8 | 50 | 1.0 | 9.2 | 0 | 0 | 1.6 | 20 | 20 |
| 325 A | 3.6 | 50 | 0 | 20 | 4.0 | 9.7 | 20 | 20 | 20 |
| 328 A | 1.4 | 50 | 6.9 | 9.6 | 0.6 | 0.1 | 50 | 50 | 50 |
| 330 A | 2.1 | 20 | 2.4 | 2.6 | 1.3 | 0 | 3.9 | 7.6 | 5.3 |
| 332 A | 2.8 | 14.5 | 3.3 | 4.6 | 2.6 | 1.3 | 0.9 | 10.5 | 20 |

TABLE 58-continued

|  |  |  |  |  |  |  |  |  |  |
|---|---|---|---|---|---|---|---|---|---|
| 239 B | 3.8 | 0.3 | 0.5 | 2.4 | 0 | 1.6 | 5.3 | 20 | 19.5 |
| 240 B | 15.1 | 3.1 | 20 | 20 | 1.0 | 0.2 | 2.4 | 20 | 20 |
| 263 B | 3.3 | 50 | 20 | 20 | 3.2 | 1.2 | 0 | 20 | 20 |
| 264 B | 3.5 | 1.7 | 3.1 | 4.1 | 3.9 | 2.9 | 1.3 | 6.9 | 20 |
| 266 B | 4.5 | 50 | 4.9 | 20 | 1.9 | 0 | 3.6 | 50 | 50 |
| 296 B | 50 | 50 | 50 | 50 | 50 | 50 | 50 | 50 | 11.3 |
| 299 B | 8.0 | 50 | 12.3 | 8.8 | 0.2 | 2.1 | 4.4 | 20 | 20 |
| 325 B | 1.3 | 10 | 2.4 | 20 | 2.3 | 2.0 | 1.0 | 20 | 50 |
| 328 B | 5.9 | 50 | 2.8 | 7.4 | 6.1 | 6.4 | 50 | 50 | 50 |
| 330 B | 0.7 | 20 | 0.6 | 1.3 | 0 | 0.4 | 4.2 | 8.2 | 3.6 |
| 332 B | 2.6 | 7.7 | 1.3 | 2.2 | 2.3 | 1.6 | 2.0 | 10.4 | 5.6 |

SPA ™ technology; D129G 1E4K template structure; +carbohydrate

TABLE 59

| Pos | WT | A | C | D | E | F | G | H | I | K | L |
|---|---|---|---|---|---|---|---|---|---|---|---|
| 239 A | S | 1.4 | 2.6 | 3.1 | 1.0 | 20 | 5.7 | 4.8 | 3.4 | 2.0 | 1.2 |
| 240 A | V | 2.9 | 3.5 | 3.7 | 4.6 | 20 | 8.2 | 10.8 | 0 | 9.1 | 3.2 |
| 263 A | V | 3.6 | 4.9 | 6.2 | 8.7 | 20 | 9.9 | 20 | 3.7 | 4.2 | 0.5 |
| 264 A | V | 1.8 | 2.8 | 3.3 | 2.0 | 2.9 | 6.2 | 3.1 | 0 | 2.4 | 0.8 |
| 266 A | V | 4.4 | 5.2 | 4.9 | 7.1 | 20 | 10.6 | 20 | 1.0 | 12.1 | 4.8 |
| 296 A | Y | 1.2 | 2.9 | 0.7 | 1.4 | 3.1 | 3.9 | 2.7 | 2.4 | 2.3 | 1.9 |
| 299 A | T | 0 | 2.6 | 6.0 | 11.5 | 20 | 5.3 | 20 | 20 | 6.0 | 20 |
| 325 A | N | 5.2 | 7.0 | 6.6 | 6.9 | 50 | 11.3 | 20 | 1.3 | 14.3 | 13.5 |
| 328 A | L | 4.8 | 5.5 | 7.0 | 3.2 | 20 | 10.5 | 20 | 50 | 5.1 | 0 |
| 330 A | A | 0.9 | 1.8 | 1.1 | 0.9 | 3.5 | 4.0 | 3.0 | 2.3 | 1.2 | 1.6 |
| 332 A | I | 5.3 | 6.4 | 6.7 | 4.8 | 8.2 | 9.9 | 5.2 | 3.1 | 0 | 3.6 |
| 239 B | S | 0.7 | 2.3 | 2.6 | 2.0 | 5.3 | 5.1 | 3.3 | 1.7 | 0 | 1.2 |
| 240 B | V | 2.3 | 3.0 | 4.1 | 7.3 | 20 | 8.1 | 20 | 5.1 | 20 | 11.8 |
| 263 B | V | 3.2 | 4.3 | 7.3 | 8.3 | 20 | 9.6 | 20 | 13.3 | 8.5 | 0.6 |
| 264 B | V | 2.1 | 3.2 | 3.7 | 2.7 | 17.8 | 6.6 | 11.5 | 0 | 2.0 | 0.8 |
| 266 B | V | 5.0 | 5.0 | 5.2 | 16.3 | 20 | 11.2 | 20 | 2.3 | 20 | 14.3 |
| 296 B | Y | 0.9 | 2.3 | 1.0 | 0.5 | 2.7 | 3.7 | 2.5 | 1.2 | 1.3 | 2.1 |
| 299 B | T | 1.1 | 2.2 | 7.6 | 5.4 | 20 | 6.4 | 12.8 | 1.8 | 3.9 | 17.5 |
| 325 B | N | 10.1 | 11.5 | 13.1 | 11.2 | 20 | 15.7 | 20 | 8.6 | 14.3 | 17.1 |
| 328 B | L | 2.9 | 4.1 | 4.8 | 3.5 | 50 | 8.5 | 1.7 | 9.6 | 1.5 | 0 |
| 330 B | A | 0.1 | 2.0 | 1.4 | 1.8 | 1.6 | 4.0 | 3.0 | 2.0 | 0.5 | 0.5 |
| 332 B | I | 3.4 | 4.4 | 3.5 | 3.1 | 6.1 | 8.2 | 4.1 | 0 | 3.3 | 1.3 |

| Pos | M | N | P | Q | R | S | T | V | W | Y |
|---|---|---|---|---|---|---|---|---|---|---|
| 239 A | 2.6 | 1.6 | 4.8 | 0 | 2.1 | 1.3 | 2.1 | 3.3 | 13.8 | 19.6 |
| 240 A | 5.4 | 3.1 | 4.8 | 5.5 | 17.5 | 4.0 | 1.8 | 1.2 | 20 | 20 |
| 263 A | 6.7 | 6.1 | 50 | 9.5 | 20 | 5.1 | 3.6 | 0 | 20 | 20 |
| 264 A | 3.0 | 2.4 | 6.1 | 1.4 | 2.8 | 2.4 | 1.9 | 0.8 | 10.2 | 2.2 |
| 266 A | 9.1 | 4.6 | 50 | 7.9 | 12.6 | 5.8 | 3.5 | 0 | 20 | 20 |
| 296 A | 2.2 | 0 | 1.6 | 1.4 | 3.0 | 0.9 | 1.0 | 3.5 | 6.0 | 2.6 |
| 299 A | 4.4 | 3.0 | 50 | 14.1 | 13.2 | 0.9 | 3.8 | 15.1 | 15.0 | 20 |
| 325 A | 13.9 | 0 | 5.0 | 6.0 | 20 | 6.0 | 4.6 | 3.2 | 20 | 50 |
| 328 A | 8.5 | 5.5 | 50 | 3.5 | 8.2 | 5.5 | 13.4 | 50 | 20 | 50 |
| 330 A | 2.8 | 0 | 14.5 | 0.9 | 1.1 | 0.1 | 0.4 | 2.0 | 6.4 | 3.2 |
| 332 A | 5.2 | 6.8 | 20 | 3.5 | 4.6 | 5.5 | 4.8 | 4.0 | 11.2 | 7.1 |
| 239 B | 2.0 | 0.8 | 15.5 | 0.9 | 0.8 | 0.7 | 0.7 | 3.3 | 8.2 | 6.0 |
| 240 B | 10.9 | 3.8 | 2.0 | 17.0 | 20 | 3.6 | 1.3 | 0 | 20 | 20 |
| 263 B | 20 | 6.0 | 50 | 8.5 | 20 | 4.6 | 4.0 | 0 | 20 | 20 |
| 264 B | 3.5 | 3.0 | 7.8 | 2.0 | 1.5 | 2.5 | 1.3 | 1.0 | 13.9 | 20 |
| 266 B | 17.3 | 2.5 | 50 | 11.6 | 20 | 5.4 | 3.9 | 0 | 20 | 20 |
| 296 B | 3.0 | 0 | 7.0 | 0.4 | 1.1 | 0.3 | 0.8 | 1.8 | 6.0 | 2.4 |
| 299 B | 6.9 | 3.9 | 20 | 4.6 | 10.3 | 0.8 | 0 | 1.9 | 20 | 20 |
| 325 B | 20 | 0 | 16.1 | 10.6 | 20 | 11.1 | 10.9 | 10.5 | 20 | 20 |
| 328 B | 1.5 | 3.5 | 50 | 3.3 | 2.0 | 3.3 | 1.9 | 5.2 | 50 | 50 |
| 330 B | 2.6 | 0 | 20 | 0.7 | 2.0 | 0.3 | 0.6 | 2.1 | 4.4 | 2.4 |
| 332 B | 3.3 | 4.0 | 15.7 | 0.8 | 2.1 | 3.9 | 2.7 | 1.1 | 20 | 6.1 |

SPA ™ technology; Fc/FcγRIIb model template structure; −carbohydrate

TABLE 60

| Pos | WT | A | C | D | E | F | G | H | I | K | L |
|---|---|---|---|---|---|---|---|---|---|---|---|
| 237 A | G | 1.0 | 3.0 | 5.9 | 1.8 | 5.0 | 4.7 | 3.1 | 1.4 | 1.4 | 4.2 |
| 238 A | P | 3.3 | 5.2 | 9.7 | 4.6 | 20 | 9.2 | 20 | 0.4 | 19.6 | 5.0 |
| 239 A | S | 0.6 | 1.8 | 3.3 | 1.3 | 1.8 | 4.7 | 0.5 | 2.1 | 0 | 0.8 |
| 240 A | V | 1.3 | 2.3 | 2.7 | 8.2 | 20 | 7.0 | 20 | 6.1 | 8.7 | 0 |

TABLE 60-continued

| | | | | | | | | | | | |
|---|---|---|---|---|---|---|---|---|---|---|---|
| 241 A | F | 0 | 2.1 | 2.4 | 0.5 | 1.0 | 4.0 | 2.6 | 7.5 | 1.7 | 0.9 |
| 242 A | L | 3.7 | 4.7 | 6.6 | 6.7 | 20 | 9.2 | 20 | 13.0 | 13.8 | 0 |
| 243 A | F | 0.8 | 2.0 | 1.0 | 0.2 | 0.3 | 4.9 | 1.5 | 4.0 | 1.5 | 0.8 |
| 244 A | P | 2.8 | 3.7 | 5.5 | 3.2 | 6.4 | 2.9 | 3.6 | 0 | 0.1 | 4.0 |
| 245 A | P | 2.5 | 20 | 20 | 20 | 20 | 7.7 | 20 | 50 | 20 | 20 |
| 246 A | K | 2.1 | 3.5 | 2.8 | 2.5 | 4.0 | 6.5 | 4.5 | 3.4 | 2.7 | 1.9 |
| 247 A | P | 2.4 | 5.0 | 6.6 | 7.8 | 50 | 7.5 | 20 | 10 | 9.6 | 50 |
| 248 A | K | 2.0 | 4.0 | 4.8 | 4.2 | 20 | 6.9 | 9.6 | 3.3 | 0 | 2.7 |
| 249 A | D | 3.3 | 4.2 | 3.3 | 0.9 | 4.8 | 9.3 | 4.0 | 50 | 3.1 | 0 |
| 250 A | T | 0.1 | 1.5 | 3.0 | 8.0 | 20 | 6.7 | 20 | 2.5 | 5.4 | 9.5 |
| 251 A | L | 3.1 | 4.6 | 6.3 | 6.1 | 2.3 | 9.5 | 1.5 | 7.2 | 3.1 | 1.3 |
| 252 A | M | 3.0 | 3.5 | 5.3 | 2.8 | 20 | 9.4 | 20 | 4.4 | 0.6 | 5.0 |
| 253 A | I | 0.9 | 1.8 | 3.9 | 3.3 | 4.0 | 5.5 | 6.2 | 1.3 | 0 | 0.9 |
| 254 A | S | 0 | 2.4 | 5.5 | 3.4 | 8.1 | 3.9 | 8.5 | 4.2 | 3.3 | 1.7 |
| 255 A | R | 2.2 | 3.8 | 5.4 | 3.9 | 7.1 | 7.3 | 1.6 | 15.8 | 0 | 0.5 |
| 256 A | T | 1.1 | 2.3 | 1.7 | 1.5 | 3.2 | 3.9 | 2.5 | 3.1 | 1.1 | 2.0 |
| 257 A | P | 2.1 | 9.1 | 20 | 16.1 | 50 | 8.5 | 50 | 20 | 20 | 20 |
| 258 A | E | 0 | 1.6 | 2.3 | 0.6 | 0.9 | 4.2 | 2.1 | 9.4 | 2.4 | 3.5 |
| 259 A | V | 4.0 | 4.3 | 7.0 | 11.4 | 20 | 10.4 | 20 | 3.2 | 14.0 | 14.9 |
| 260 A | T | 2.6 | 2.8 | 3.2 | 0 | 20 | 7.3 | 5.6 | 1.7 | 3.1 | 5.5 |
| 261 A | C | 0 | 18.6 | 20 | 20 | 20 | 3.8 | 20 | 20 | 20 | 20 |
| 262 A | V | 1.8 | 1.5 | 1.3 | 11.1 | 20 | 7.1 | 20 | 5.8 | 14.6 | 20 |
| 263 A | V | 4.5 | 5.1 | 6.5 | 14.1 | 20 | 10.8 | 20 | 8.0 | 6.1 | 3.2 |
| 264 A | V | 2.6 | 3.2 | 3.7 | 2.0 | 14.0 | 7.0 | 9.0 | 0 | 2.6 | 2.5 |
| 265 A | D | 1.4 | 2.8 | 2.7 | 1.6 | 1.8 | 2.5 | 2.2 | 18.5 | 0 | 0.1 |
| 266 A | V | 4.8 | 5.1 | 5.0 | 14.2 | 20 | 11.5 | 20 | 0.2 | 20 | 9.8 |
| 267 A | S | 2.6 | 4.9 | 5.7 | 3.3 | 1.6 | 7.2 | 2.9 | 0.5 | 1.0 | 2.0 |
| 268 A | H | 1.5 | 1.9 | 2.6 | 2.6 | 4.4 | 4.8 | 2.7 | 1.7 | 0 | 2.8 |
| 269 A | E | 0.3 | 2.0 | 0.8 | 0.6 | 2.8 | 3.6 | 2.7 | 1.5 | 1.6 | 1.4 |
| 270 A | N | 0 | 1.4 | 1.9 | 3.8 | 0.7 | 3.9 | 2.2 | 6.8 | 2.4 | 3.5 |
| 271 A | P | 0.9 | 2.2 | 5.7 | 6.5 | 3.0 | 5.5 | 2.9 | 12.8 | 5.4 | 15.7 |
| 272 A | E | 0.7 | 1.8 | 0.3 | 0.4 | 3.0 | 3.6 | 2.6 | 1.7 | 1.4 | 2.0 |
| 273 A | V | 3.1 | 4.0 | 2.1 | 15.5 | 20 | 8.9 | 20 | 0.5 | 10.6 | 7.1 |
| 274 A | K | 0.6 | 2.1 | 1.5 | 0.9 | 2.2 | 4.3 | 2.6 | 1.6 | 1.3 | 1.2 |
| 275 A | F | 7.1 | 8.6 | 10.1 | 8.0 | 0 | 12.2 | 4.2 | 7.7 | 4.7 | 5.5 |
| 276 A | N | 0.5 | 1.8 | 1.3 | 0 | 20 | 5.4 | 20 | 12.6 | 2.6 | 3.2 |
| 277 A | W | 9.3 | 11.1 | 12.3 | 10.7 | 4.1 | 15.0 | 8.6 | 10.2 | 7.3 | 7.8 |
| 278 A | Y | 0.1 | 1.9 | 6.1 | 0 | 2.7 | 5.5 | 4.5 | 16.4 | 1.3 | 16.3 |
| 279 A | V | 3.2 | 4.4 | 5.1 | 3.1 | 20 | 8.2 | 19.7 | 0.3 | 0 | 1.9 |
| 280 A | D | 3.6 | 3.5 | 0 | 2.7 | 12.5 | 4.0 | 9.9 | 17.6 | 3.8 | 2.8 |
| 281 A | G | 50 | 50 | 50 | 50 | 50 | 0 | 50 | 50 | 50 | 50 |
| 282 A | V | 0.5 | 1.8 | 1.8 | 0.8 | 2.2 | 4.0 | 2.2 | 0.7 | 0.9 | 1.3 |
| 283 A | E | 0.9 | 1.2 | 4.9 | 0 | 7.9 | 4.4 | 4.2 | 2.2 | 1.3 | 4.7 |
| 284 A | V | 2.1 | 2.6 | 4.4 | 2.6 | 15.0 | 6.7 | 4.4 | 2.0 | 1.8 | 6.3 |
| 285 A | H | 1.0 | 2.3 | 1.9 | 1.3 | 2.8 | 2.8 | 2.6 | 2.0 | 1.6 | 2.2 |
| 286 A | N | 0.9 | 1.7 | 0.7 | 0.1 | 3.3 | 3.4 | 3.2 | 0 | 0.9 | 2.1 |
| 287 A | A | 2.4 | 4.3 | 5.1 | 8.4 | 0 | 8.4 | 3.1 | 11.2 | 6.6 | 17.4 |
| 288 A | K | 0.7 | 1.9 | 2.0 | 0.9 | 2.7 | 3.9 | 2.6 | 1.0 | 1.3 | 1.9 |
| 289 A | T | 1.0 | 1.7 | 2.2 | 0.5 | 6.6 | 4.7 | 2.3 | 0.5 | 0.3 | 0.5 |
| 290 A | K | 1.1 | 2.6 | 2.6 | 1.6 | 3.8 | 5.6 | 5.4 | 3.1 | 0.8 | 0.4 |
| 291 A | P | 1.0 | 2.4 | 1.8 | 1.7 | 4.5 | 3.6 | 3.4 | 2.6 | 1.6 | 2.6 |
| 292 A | R | 1.5 | 3.2 | 3.2 | 1.9 | 1.7 | 5.2 | 3.0 | 1.8 | 1.0 | 0 |
| 293 A | E | 0.6 | 2.1 | 1.5 | 0.4 | 8.0 | 4.3 | 5.5 | 3.2 | 1.4 | 0.8 |
| 294 A | E | 2.3 | 2.5 | 0.5 | 0.5 | 5.0 | 5.8 | 3.5 | 4.1 | 1.5 | 2.0 |
| 295 A | Q | 3.1 | 3.2 | 3.8 | 2.8 | 17.6 | 7.8 | 12.8 | 9.7 | 1.3 | 0 |
| 296 A | Y | 3.3 | 3.5 | 3.6 | 2.3 | 4.7 | 0 | 3.5 | 50 | 2.6 | 3.6 |
| 297 A | N | 1.4 | 2.3 | 3.2 | 1.4 | 4.4 | 4.3 | 3.0 | 0.6 | 0.7 | 2.2 |
| 298 A | S | 6.5 | 7.1 | 6.9 | 6.9 | 11.0 | 0 | 8.6 | 50 | 6.6 | 7.2 |
| 299 A | T | 0.3 | 2.2 | 3.0 | 20 | 0.5 | 4.4 | 0.5 | 5.1 | 1.5 | 16.2 |
| 300 A | Y | 4.1 | 4.8 | 5.1 | 5.2 | 0 | 9.8 | 2.2 | 11.9 | 3.3 | 2.6 |
| 301 A | R | 1.6 | 2.4 | 1.1 | 0.6 | 20 | 6.5 | 20 | 8.6 | 0 | 3.5 |
| 302 A | V | 3.2 | 4.0 | 5.0 | 4.0 | 20 | 9.0 | 5.6 | 0.3 | 1.6 | 2.3 |
| 303 A | V | 0.9 | 1.0 | 2.0 | 0 | 20 | 5.9 | 20 | 3.0 | 4.4 | 12.4 |
| 304 A | S | 1.1 | 2.3 | 4.1 | 9.2 | 20 | 7.8 | 20 | 7.6 | 6.9 | 20 |
| 305 A | V | 1.6 | 2.1 | 1.8 | 4.1 | 20 | 6.3 | 20 | 1.0 | 3.9 | 2.9 |
| 306 A | L | 5.1 | 6.8 | 6.7 | 7.0 | 1.7 | 11.5 | 4.9 | 3.8 | 3.9 | 0 |
| 307 A | T | 1.5 | 3.0 | 2.6 | 1.6 | 1.1 | 5.5 | 3.0 | 0.2 | 1.7 | 1.0 |
| 308 A | V | 4.0 | 4.5 | 12.8 | 7.2 | 20 | 10.2 | 20 | 0 | 17.1 | 5.0 |
| 309 A | L | 1.3 | 2.8 | 1.8 | 1.7 | 3.2 | 5.5 | 3.3 | 0.8 | 1.5 | 1.0 |
| 310 A | H | 1.6 | 2.2 | 2.1 | 4.0 | 18.6 | 6.3 | 4.2 | 3.5 | 3.2 | 6.7 |
| 311 A | Q | 0.2 | 1.6 | 1.4 | 0.7 | 1.9 | 3.9 | 1.6 | 0.4 | 0.7 | 0.7 |
| 312 A | D | 0 | 1.6 | 0.8 | 0.9 | 20 | 5.3 | 11.3 | 8.9 | 2.4 | 2.3 |
| 313 A | W | 4.0 | 5.5 | 7.0 | 5.1 | 0 | 10 | 5.1 | 11.0 | 2.7 | 4.2 |
| 314 A | L | 2.8 | 4.3 | 5.8 | 3.7 | 20 | 7.6 | 7.3 | 4.2 | 1.8 | 0 |
| 315 A | N | 0 | 5.1 | 3.1 | 3.4 | 11.1 | 2.6 | 11.3 | 16.1 | 3.4 | 3.4 |
| 316 A | G | 11.4 | 10 | 11.1 | 8.9 | 16.6 | 0 | 12.7 | 50 | 8.5 | 8.8 |
| 317 A | K | 3.1 | 4.8 | 8.1 | 5.6 | 6.5 | 8.4 | 2.5 | 7.3 | 0 | 5.5 |
| 318 A | E | 1.5 | 2.5 | 2.8 | 1.7 | 20 | 5.8 | 9.6 | 2.0 | 1.9 | 5.9 |
| 319 A | Y | 7.0 | 7.9 | 9.4 | 9.9 | 0 | 12.8 | 4.6 | 3.2 | 6.0 | 6.6 |

TABLE 60-continued

| | | | | | | | | | | | |
|---|---|---|---|---|---|---|---|---|---|---|---|
| 320 A | K | 1.8 | 2.9 | 6.7 | 1.8 | 20 | 7.1 | 20 | 1.1 | 0 | 8.1 |
| 321 A | C | 0 | 3.9 | 20 | 20 | 20 | 6.1 | 20 | 20 | 20 | 20 |
| 322 A | K | 2.4 | 3.3 | 6.1 | 3.0 | 20 | 8.0 | 20 | 1.1 | 0.4 | 16.9 |
| 323 A | V | 3.5 | 4.3 | 8.0 | 9.0 | 20 | 9.9 | 20 | 4.7 | 10.2 | 20 |
| 324 A | S | 0.4 | 2.0 | 0.9 | 0 | 0.2 | 5.0 | 2.5 | 1.3 | 1.3 | 0 |
| 325 A | N | 4.9 | 5.9 | 6.3 | 6.0 | 20 | 10.4 | 20 | 1.7 | 14.0 | 11.3 |
| 326 A | K | 1.6 | 3.6 | 2.4 | 2.4 | 3.8 | 4.9 | 3.0 | 10.6 | 1.4 | 2.9 |
| 327 A | A | 2.7 | 3.8 | 5.5 | 2.8 | 11.6 | 7.1 | 9.5 | 3.2 | 1.2 | 3.7 |
| 328 A | L | 2.5 | 3.7 | 4.6 | 1.7 | 50 | 7.4 | 20 | 5.7 | 1.8 | 0 |
| 329 A | P | 0.8 | 2.2 | 1.2 | 1.2 | 4.0 | 3.3 | 3.3 | 2.9 | 1.6 | 2.5 |
| 330 A | A | 0.3 | 1.6 | 2.0 | 1.3 | 3.4 | 3.2 | 2.3 | 2.4 | 1.3 | 2.5 |
| 331 A | P | 1.5 | 3.5 | 8.0 | 10.4 | 6.6 | 6.3 | 5.0 | 9.3 | 8.1 | 12.6 |
| 332 A | I | 2.4 | 3.5 | 2.6 | 2.2 | 7.9 | 7.2 | 4.0 | 1.3 | 2.3 | 0.7 |
| 333 A | E | 2.0 | 2.7 | 2.6 | 0 | 8.0 | 6.3 | 7.6 | 3.1 | 3.5 | 5.9 |
| 334 A | K | 2.1 | 3.4 | 3.5 | 2.0 | 7.1 | 7.1 | 3.5 | 2.0 | 2.2 | 3.0 |
| 335 A | T | 0.5 | 1.0 | 2.1 | 0.3 | 4.6 | 4.6 | 4.1 | 0.6 | 0.2 | 4.0 |
| 336 A | I | 0.4 | 1.4 | 2.2 | 0.9 | 13.9 | 4.8 | 4.7 | 0 | 1.3 | 4.3 |
| 337 A | S | 0.3 | 0.8 | 4.0 | 13.5 | 20 | 3.1 | 20 | 50 | 9.9 | 9.3 |
| 338 A | K | 4.7 | 8.3 | 7.1 | 7.6 | 20 | 9.8 | 20 | 5.5 | 0 | 2.3 |
| 339 A | A | 1.4 | 2.7 | 3.1 | 2.2 | 2.3 | 5.5 | 3.3 | 0 | 0.5 | 0.2 |
| 340 A | K | 1.2 | 3.0 | 2.0 | 1.5 | 1.9 | 3.9 | 2.5 | 2.6 | 0.2 | 2.2 |
| 237 B | G | 0.6 | 2.2 | 1.7 | 0.5 | 5.0 | 4.2 | 2.5 | 0.3 | 0.3 | 4.1 |
| 238 B | P | 3.0 | 5.3 | 8.9 | 5.4 | 20 | 9.1 | 20 | 1.1 | 14.4 | 3.6 |
| 239 B | S | 0.7 | 2.0 | 2.9 | 1.1 | 2.2 | 4.8 | 0.5 | 2.9 | 0 | 0.8 |
| 240 B | V | 2.0 | 3.0 | 3.4 | 5.3 | 20 | 7.7 | 20 | 6.4 | 11.3 | 0 |
| 241 B | F | 0.3 | 2.0 | 2.7 | 0.2 | 1.5 | 4.3 | 3.2 | 5.7 | 1.3 | 1.2 |
| 242 B | L | 4.0 | 5.1 | 7.0 | 6.5 | 20 | 9.5 | 20 | 12.9 | 13.6 | 0 |
| 243 B | F | 0.7 | 1.8 | 1.2 | 0 | 0.2 | 4.9 | 1.5 | 4.8 | 1.4 | 0.8 |
| 244 B | P | 2.1 | 3.1 | 5.4 | 2.8 | 7.0 | 3.5 | 3.7 | 0.7 | 0 | 3.6 |
| 245 B | P | 2.1 | 20 | 20 | 20 | 20 | 7.3 | 20 | 50 | 20 | 20 |
| 246 B | K | 1.4 | 2.8 | 1.8 | 2.0 | 3.4 | 5.8 | 3.9 | 2.3 | 1.8 | 1.2 |
| 247 B | P | 2.4 | 5.0 | 8.4 | 7.4 | 20 | 7.5 | 18.5 | 8.7 | 9.4 | 20 |
| 248 B | K | 2.0 | 4.1 | 4.6 | 3.7 | 20 | 6.8 | 9.1 | 3.7 | 0 | 2.2 |
| 249 B | D | 3.2 | 4.2 | 3.1 | 1.2 | 3.2 | 9.1 | 4.0 | 50 | 2.9 | 0 |
| 250 B | T | 0.1 | 1.4 | 3.1 | 7.4 | 20 | 6.7 | 20 | 2.9 | 5.9 | 8.9 |
| 251 B | L | 4.0 | 5.6 | 6.9 | 7.9 | 3.5 | 10.4 | 1.9 | 4.9 | 5.0 | 2.1 |
| 252 B | M | 3.0 | 3.6 | 5.6 | 2.9 | 20 | 9.2 | 20 | 6.0 | 1.0 | 4.9 |
| 253 B | I | 1.5 | 2.3 | 4.6 | 3.5 | 4.6 | 6.1 | 6.8 | 1.7 | 0 | 1.6 |
| 254 B | S | 0 | 2.8 | 6.1 | 3.4 | 8.5 | 4.1 | 9.9 | 4.5 | 4.2 | 1.5 |
| 255 B | R | 1.8 | 3.7 | 5.0 | 3.7 | 3.5 | 6.8 | 0.8 | 14.1 | 0.1 | 0 |
| 256 B | T | 1.0 | 2.3 | 1.6 | 1.4 | 3.1 | 3.7 | 2.3 | 3.5 | 1.2 | 1.9 |
| 257 B | P | 2.0 | 10.4 | 20 | 20 | 50 | 8.4 | 50 | 20 | 20 | 17.3 |
| 258 B | E | 0 | 1.6 | 2.7 | 0.8 | 0.8 | 3.9 | 2.0 | 12.0 | 2.4 | 4.0 |
| 259 B | V | 4.1 | 4.5 | 7.0 | 9.1 | 20 | 10.5 | 20 | 1.5 | 12.2 | 14.4 |
| 260 B | T | 2.4 | 2.7 | 3.0 | 0 | 20 | 7.2 | 7.2 | 1.6 | 3.0 | 5.3 |
| 261 B | C | 0 | 18.0 | 20 | 20 | 20 | 4.0 | 20 | 20 | 20 | 20 |
| 262 B | V | 1.6 | 1.5 | 0.8 | 20 | 20 | 7.0 | 20 | 8.4 | 16.8 | 20 |
| 263 B | V | 4.5 | 5.2 | 5.5 | 18.4 | 20 | 10.9 | 20 | 10.9 | 4.6 | 3.5 |
| 264 B | V | 2.6 | 3.0 | 3.7 | 1.6 | 12.8 | 7.1 | 12.2 | 0 | 2.3 | 3.1 |
| 265 B | D | 1.4 | 2.7 | 2.4 | 1.3 | 2.0 | 2.3 | 2.3 | 50 | 1.0 | 0 |
| 266 B | V | 4.9 | 5.4 | 7.0 | 15.9 | 20 | 11.6 | 20 | 2.7 | 20 | 20 |
| 267 B | S | 2.4 | 4.6 | 4.3 | 4.3 | 1.3 | 7.1 | 2.8 | 1.3 | 0.9 | 1.7 |
| 268 B | H | 2.1 | 2.9 | 3.8 | 2.4 | 6.9 | 5.5 | 2.0 | 1.7 | 0 | 4.9 |
| 269 B | E | 0.8 | 2.5 | 0.9 | 1.2 | 3.3 | 4.0 | 2.9 | 1.2 | 2.0 | 2.2 |
| 270 B | N | 0 | 1.3 | 0.9 | 3.9 | 2.9 | 3.8 | 4.8 | 5.7 | 3.5 | 1.2 |
| 271 B | P | 0.8 | 2.5 | 6.0 | 7.8 | 3.1 | 5.6 | 4.2 | 16.4 | 5.7 | 16.9 |
| 272 B | E | 0.7 | 1.7 | 0.1 | 0 | 3.0 | 3.7 | 2.8 | 1.0 | 1.9 | 1.8 |
| 273 B | V | 4.8 | 5.5 | 5.1 | 16.6 | 20 | 10.8 | 20 | 3.1 | 9.6 | 7.2 |
| 274 B | K | 0.8 | 2.4 | 1.6 | 1.0 | 2.3 | 4.5 | 2.7 | 1.5 | 1.5 | 1.4 |
| 275 B | F | 6.9 | 8.5 | 9.9 | 8.0 | 0 | 12.1 | 3.7 | 8.2 | 4.8 | 5.5 |
| 276 B | N | 0.4 | 1.6 | 1.2 | 0 | 20 | 5.3 | 20 | 9.1 | 2.7 | 3.1 |
| 277 B | W | 8.9 | 10.9 | 11.6 | 10.6 | 4.8 | 14.6 | 7.8 | 10.1 | 6.3 | 7.6 |
| 278 B | Y | 0.8 | 2.1 | 5.6 | 0 | 1.4 | 6.3 | 3.9 | 18.3 | 1.3 | 12.7 |
| 279 B | V | 3.8 | 4.9 | 5.9 | 3.8 | 20 | 8.8 | 16.0 | 1.0 | 0 | 2.8 |
| 280 B | D | 3.5 | 3.4 | 0 | 1.8 | 12.4 | 3.9 | 9.8 | 17.0 | 3.6 | 2.3 |
| 281 B | G | 50 | 50 | 50 | 50 | 2.2 | 50 | 0 | 50 | 50 | 50 |
| 282 B | V | 0.4 | 1.8 | 1.7 | 0.8 | 2.2 | 3.9 | 2.1 | 0.8 | 0.9 | 1.3 |
| 283 B | E | 0.9 | 1.2 | 4.9 | 0 | 7.8 | 4.7 | 4.3 | 1.7 | 1.5 | 4.7 |
| 284 B | V | 2.3 | 2.7 | 5.0 | 2.6 | 16.4 | 7.0 | 5.5 | 3.1 | 2.0 | 7.0 |
| 285 B | H | 0.6 | 2.0 | 1.8 | 1.0 | 2.4 | 2.5 | 2.3 | 2.0 | 1.4 | 1.9 |
| 286 B | N | 1.0 | 1.8 | 0.9 | 0.2 | 3.4 | 3.5 | 3.1 | 0 | 1.4 | 2.2 |
| 287 B | A | 2.5 | 4.3 | 5.5 | 8.5 | 0 | 8.4 | 3.2 | 13.3 | 6.7 | 17.7 |
| 288 B | K | 0.6 | 1.7 | 1.6 | 0.8 | 2.5 | 3.7 | 2.5 | 1.0 | 1.4 | 1.7 |
| 289 B | T | 0.9 | 1.5 | 2.1 | 0.5 | 5.4 | 4.6 | 2.3 | 0 | 0.2 | 0.2 |
| 290 B | K | 0.7 | 2.4 | 2.5 | 1.2 | 3.2 | 5.2 | 5.2 | 2.4 | 0.2 | 0.1 |
| 291 B | P | 1.0 | 2.5 | 2.0 | 1.7 | 4.5 | 3.6 | 3.4 | 2.5 | 1.6 | 2.6 |
| 292 B | R | 1.8 | 3.5 | 3.5 | 2.2 | 1.6 | 5.5 | 2.8 | 2.2 | 1.1 | 0 |
| 293 B | E | 0.7 | 2.2 | 1.6 | 0.6 | 8.6 | 4.5 | 4.7 | 2.8 | 1.5 | 0.9 |
| 294 B | E | 2.1 | 2.2 | 0.5 | 0.4 | 5.2 | 5.7 | 3.3 | 2.8 | 1.3 | 3.0 |

TABLE 60-continued

| | | | | | | | | | | |
|---|---|---|---|---|---|---|---|---|---|---|
| 295 B | Q | 3.3 | 3.1 | 4.0 | 3.1 | 18.8 | 7.6 | 13.1 | 8.3 | 1.2 | 0 |
| 296 B | Y | 4.2 | 4.4 | 4.5 | 3.6 | 5.6 | 0 | 4.4 | 50 | 3.4 | 4.4 |
| 297 B | N | 1.3 | 2.1 | 3.1 | 1.4 | 4.0 | 4.2 | 2.7 | 0.3 | 1.3 | 2.1 |
| 298 B | S | 5.5 | 6.0 | 6.3 | 5.7 | 9.7 | 0 | 7.5 | 50 | 5.7 | 6.3 |
| 299 B | T | 1.1 | 3.1 | 3.5 | 15.2 | 0.9 | 5.9 | 0 | 6.3 | 1.4 | 10.9 |
| 300 B | Y | 3.1 | 3.7 | 4.0 | 3.8 | 2.9 | 8.8 | 2.3 | 10.5 | 2.0 | 1.5 |
| 301 B | R | 1.5 | 2.3 | 1.4 | 0.3 | 20 | 6.4 | 20 | 6.8 | 0.1 | 3.8 |
| 302 B | V | 3.4 | 4.0 | 5.8 | 3.9 | 20 | 9.3 | 7.0 | 0.2 | 1.8 | 3.4 |
| 303 B | V | 0.2 | 0.2 | 1.2 | 1.2 | 20 | 5.3 | 20 | 5.8 | 3.9 | 11.4 |
| 304 B | S | 1.0 | 1.9 | 4.1 | 10.8 | 20 | 7.8 | 20 | 8.3 | 7.4 | 20 |
| 305 B | V | 1.5 | 1.8 | 1.7 | 3.9 | 20 | 6.2 | 20 | 0.7 | 3.2 | 4.2 |
| 306 B | L | 5.2 | 7.1 | 6.7 | 7.3 | 1.5 | 11.6 | 4.9 | 3.7 | 5.1 | 0 |
| 307 B | T | 1.6 | 3.0 | 2.5 | 1.9 | 1.1 | 5.5 | 3.0 | 0.2 | 1.6 | 1.2 |
| 308 B | V | 5.1 | 5.8 | 12.7 | 7.4 | 20 | 11.3 | 20 | 0 | 19.1 | 6.1 |
| 309 B | L | 1.3 | 2.8 | 1.9 | 1.7 | 3.2 | 5.4 | 3.3 | 0.9 | 1.5 | 1.0 |
| 310 B | H | 1.7 | 2.4 | 2.5 | 3.8 | 13.1 | 6.4 | 5.5 | 3.6 | 3.6 | 7.5 |
| 311 B | Q | 0 | 1.6 | 1.1 | 0.5 | 0.9 | 3.7 | 1.6 | 0.4 | 0.6 | 0.6 |
| 312 B | D | 0 | 1.7 | 0.8 | 4.6 | 20 | 5.3 | 20 | 11.0 | 3.1 | 2.9 |
| 313 B | W | 4.4 | 5.9 | 7.2 | 5.7 | 0 | 10.3 | 5.3 | 9.3 | 3.0 | 4.3 |
| 314 B | L | 2.8 | 4.4 | 5.7 | 3.7 | 20 | 7.6 | 8.3 | 4.5 | 1.6 | 0 |
| 315 B | N | 0 | 7.4 | 3.9 | 5.2 | 12.9 | 2.1 | 12.0 | 14.7 | 4.5 | 3.3 |
| 316 B | G | 8.9 | 7.7 | 9.2 | 6.9 | 13.3 | 0 | 10.8 | 50 | 6.7 | 6.8 |
| 317 B | K | 2.6 | 4.3 | 7.6 | 5.9 | 6.7 | 7.4 | 2.3 | 7.5 | 0 | 4.8 |
| 318 B | E | 1.7 | 2.6 | 2.9 | 1.6 | 20 | 6.0 | 9.6 | 1.8 | 2.2 | 6.1 |
| 319 B | Y | 6.9 | 7.8 | 9.3 | 10.1 | 0 | 12.7 | 4.7 | 3.1 | 6.2 | 7.1 |
| 320 B | K | 1.7 | 2.9 | 6.7 | 1.9 | 20 | 7.0 | 20 | 0.6 | 0 | 8.9 |
| 321 B | C | 0 | 4.5 | 20 | 20 | 20 | 6.2 | 20 | 20 | 20 | 20 |
| 322 B | K | 2.8 | 3.8 | 6.2 | 3.3 | 20 | 8.4 | 20 | 1.8 | 0.8 | 16.3 |
| 323 B | V | 3.5 | 4.4 | 8.8 | 7.6 | 20 | 9.8 | 20 | 5.4 | 9.2 | 20 |
| 324 B | S | 0.5 | 2.5 | 1.4 | 0.6 | 0.4 | 5.2 | 2.7 | 3.5 | 0 | 0.2 |
| 325 B | N | 4.1 | 5.5 | 6.9 | 5.7 | 20 | 9.6 | 20 | 1.0 | 10.5 | 11.2 |
| 326 B | K | 0.9 | 2.8 | 1.8 | 1.8 | 2.6 | 4.4 | 2.5 | 4.2 | 1.3 | 2.9 |
| 327 B | A | 3.1 | 4.4 | 6.1 | 3.2 | 10.3 | 7.4 | 4.0 | 7.0 | 2.8 | 2.5 |
| 328 B | L | 4.7 | 5.4 | 6.6 | 3.3 | 20 | 9.8 | 20 | 50 | 4.1 | 0 |
| 329 B | P | 0.6 | 2.1 | 0.9 | 1.0 | 3.8 | 3.2 | 2.8 | 2.2 | 1.3 | 2.4 |
| 330 B | A | 0.4 | 1.8 | 1.5 | 1.2 | 3.4 | 3.3 | 2.7 | 2.1 | 1.3 | 1.9 |
| 331 B | P | 1.6 | 3.6 | 7.8 | 10.6 | 7.3 | 6.5 | 4.6 | 8.9 | 7.7 | 13.6 |
| 332 B | I | 2.0 | 3.0 | 2.6 | 0.9 | 5.8 | 6.9 | 2.6 | 0 | 2.1 | 0.1 |
| 333 B | E | 2.2 | 2.8 | 2.7 | 0 | 8.1 | 6.4 | 7.8 | 3.4 | 3.6 | 6.1 |
| 334 B | K | 2.2 | 3.4 | 4.2 | 2.1 | 10.4 | 7.2 | 4.1 | 1.7 | 1.8 | 3.1 |
| 335 B | T | 0.5 | 1.1 | 1.9 | 0.8 | 4.8 | 4.6 | 4.4 | 0.5 | 0.3 | 3.7 |
| 336 B | I | 0.7 | 1.5 | 2.5 | 1.0 | 18.4 | 5.0 | 5.4 | 0.1 | 1.9 | 4.6 |
| 337 B | S | 0.4 | 1.1 | 4.9 | 10.6 | 20 | 3.4 | 20 | 50 | 7.9 | 11.0 |
| 338 B | K | 4.5 | 8.2 | 7.4 | 8.0 | 20 | 9.6 | 20 | 5.3 | 0 | 2.0 |
| 339 B | A | 1.5 | 2.8 | 3.0 | 2.1 | 2.4 | 5.5 | 3.3 | 0 | 0.4 | 0.2 |
| 340 B | K | 1.0 | 2.7 | 1.7 | 1.3 | 1.7 | 3.7 | 2.1 | 2.4 | 0 | 2.1 |

| Pos | M | N | P | Q | R | S | T | V | W | Y |
|---|---|---|---|---|---|---|---|---|---|---|
| 237 A | 3.7 | 2.5 | 0.5 | 1.3 | 1.5 | 0 | 1.2 | 1.9 | 7.5 | 5.6 |
| 238 A | 8.2 | 7.3 | 0 | 6.1 | 20 | 1.3 | 3.7 | 2.1 | 20 | 20 |
| 239 A | 2.6 | 0.2 | 8.4 | 0.9 | 0.5 | 0.3 | 1.3 | 2.5 | 4.7 | 1.8 |
| 240 A | 9.2 | 2.2 | 0.3 | 7.4 | 20 | 2.0 | 0 | 0.4 | 20 | 20 |
| 241 A | 2.8 | 0.7 | 10 | 0.7 | 1.4 | 0 | 0.9 | 6.9 | 3.9 | 0.9 |
| 242 A | 7.0 | 5.7 | 3.6 | 9.2 | 20 | 4.8 | 4.7 | 3.4 | 20 | 20 |
| 243 A | 2.2 | 0.3 | 50 | 0 | 0.5 | 0.5 | 0.5 | 4.0 | 4.3 | 0.6 |
| 244 A | 3.7 | 3.8 | 0.3 | 1.1 | 0.9 | 1.4 | 1.5 | 0.9 | 7.7 | 6.9 |
| 245 A | 20 | 20 | 0 | 20 | 20 | 3.4 | 19.2 | 50 | 20 | 20 |
| 246 A | 4.1 | 0 | 1.2 | 2.7 | 2.3 | 2.2 | 2.5 | 2.9 | 6.8 | 3.7 |
| 247 A | 6.5 | 9.5 | 0 | 7.0 | 8.4 | 0.1 | 0.6 | 4.6 | 20 | 50 |
| 248 A | 3.0 | 4.1 | 2.4 | 3.1 | 3.0 | 2.1 | 0.8 | 2.0 | 15.2 | 20 |
| 249 A | 3.2 | 3.1 | 50 | 1.9 | 4.1 | 4.4 | 8.1 | 50 | 6.3 | 5.3 |
| 250 A | 5.7 | 2.2 | 50 | 7.3 | 10.7 | 1.6 | 0.8 | 0 | 20 | 20 |
| 251 A | 5.4 | 4.7 | 50 | 5.2 | 4.4 | 4.8 | 2.1 | 2.4 | 50 | 0 |
| 252 A | 0 | 4.7 | 50 | 2.9 | 14.2 | 0.9 | 6.7 | 6.0 | 20 | 20 |
| 253 A | 1.8 | 2.3 | 50 | 2.6 | 2.7 | 1.2 | 1.2 | 2.0 | 5.8 | 4.2 |
| 254 A | 5.0 | 2.1 | 50 | 4.4 | 4.6 | 0.2 | 5.1 | 6.0 | 9.0 | 8.9 |
| 255 A | 1.5 | 3.2 | 50 | 2.0 | 0.6 | 2.0 | 1.4 | 14.5 | 5.4 | 20 |
| 256 A | 2.7 | 0 | 2.3 | 0.4 | 0.3 | 0.7 | 1.6 | 2.4 | 6.0 | 3.0 |
| 257 A | 20 | 20 | 0 | 18.6 | 20 | 4.1 | 20 | 20 | 50 | 50 |
| 258 A | 1.9 | 1.9 | 14.7 | 2.2 | 2.7 | 0.9 | 4.1 | 10.4 | 20 | 1.0 |
| 259 A | 10.6 | 7.7 | 50 | 12.2 | 20 | 5.1 | 1.8 | 0 | 20 | 20 |
| 260 A | 3.5 | 2.7 | 4.5 | 1.1 | 3.0 | 2.5 | 2.0 | 2.0 | 14.0 | 20 |
| 261 A | 20 | 20 | 50 | 20 | 20 | 4.2 | 20 | 20 | 20 | 20 |
| 262 A | 20 | 2.0 | 3.6 | 50 | 20 | 16.5 | 2.1 | 1.9 | 0 | 20 |
| 263 A | 10.9 | 5.7 | 50 | 14.4 | 18.7 | 6.0 | 3.6 | 0 | 20 | 20 |
| 264 A | 3.8 | 2.3 | 10.4 | 1.9 | 2.4 | 2.6 | 1.6 | 0.5 | 15.9 | 18.2 |
| 265 A | 2.5 | 1.1 | 50 | 0.5 | 0.8 | 1.6 | 11.8 | 19.0 | 4.9 | 2.1 |
| 266 A | 20 | 5.4 | 50 | 19.9 | 20 | 6.3 | 4.2 | 0 | 50 | 20 |

TABLE 60-continued

| | | | | | | | | | | |
|---|---|---|---|---|---|---|---|---|---|---|
| 267 A | 3.7 | 3.7 | 0 | 2.2 | 1.5 | 1.9 | 1.3 | 2.6 | 5.6 | 2.3 |
| 268 A | 1.9 | 0.6 | 0.5 | 0.9 | 1.0 | 0.7 | 1.8 | 1.6 | 7.3 | 4.6 |
| 269 A | 2.9 | 0 | 6.8 | 0.5 | 1.5 | 0.1 | 0.3 | 1.3 | 5.3 | 2.7 |
| 270 A | 2.7 | 1.6 | 13.3 | 3.2 | 3.0 | 0.9 | 1.2 | 5.1 | 2.2 | 1.0 |
| 271 A | 5.6 | 4.2 | 0 | 8.0 | 4.2 | 1.3 | 2.9 | 7.5 | 4.3 | 2.6 |
| 272 A | 2.9 | 0.3 | 11.8 | 0.2 | 1.6 | 0 | 0.9 | 1.2 | 4.4 | 2.8 |
| 273 A | 12.4 | 1.2 | 50 | 20 | 20 | 1.4 | 0 | 0.7 | 20 | 20 |
| 274 A | 2.9 | 0.9 | 50 | 0 | 0.6 | 0.6 | 1.1 | 1.4 | 2.8 | 2.2 |
| 275 A | 6.8 | 8.3 | 7.0 | 7.1 | 11.9 | 8.1 | 7.3 | 7.4 | 10.3 | 1.8 |
| 276 A | 3.0 | 0.2 | 18.7 | 1.3 | 1.8 | 1.1 | 6.3 | 10.8 | 20 | 20 |
| 277 A | 7.9 | 11.4 | 7.6 | 9.5 | 14.6 | 10.2 | 9.6 | 11.3 | 0 | 20 |
| 278 A | 1.5 | 3.3 | 50 | 0.3 | 2.2 | 0.5 | 0 | 10 | 8.6 | 1.0 |
| 279 A | 3.1 | 3.8 | 20 | 0.5 | 3.6 | 3.8 | 2.3 | 1.6 | 20 | 20 |
| 280 A | 3.9 | 0.5 | 50 | 3.1 | 3.5 | 3.1 | 8.9 | 13.1 | 13.7 | 13.0 |
| 281 A | 50 | 50 | 50 | 50 | 50 | 50 | 19.2 | 50 | 50 | 50 |
| 282 A | 3.0 | 0.4 | 50 | 0.4 | 0.5 | 0.1 | 0.5 | 0 | 5.4 | 2.5 |
| 283 A | 1.3 | 3.1 | 0.5 | 0.5 | 1.3 | 0.6 | 1.6 | 3.0 | 8.3 | 7.2 |
| 284 A | 2.6 | 2.7 | 15.1 | 2.4 | 1.6 | 2.6 | 1.3 | 0 | 11.1 | 16.1 |
| 285 A | 2.8 | 0 | 1.8 | 0.9 | 0.9 | 0.3 | 0.5 | 2.3 | 5.1 | 2.3 |
| 286 A | 2.3 | 0.2 | 6.6 | 0.4 | 0.9 | 0.7 | 0.7 | 0.8 | 5.4 | 3.4 |
| 287 A | 4.4 | 1.3 | 12.9 | 8.3 | 8.6 | 4.1 | 4.5 | 9.9 | 1.4 | 2.0 |
| 288 A | 2.2 | 0.4 | 5.0 | 0.5 | 0.6 | 0 | 0.5 | 1.8 | 6.0 | 2.6 |
| 289 A | 1.6 | 1.2 | 0.8 | 0.6 | 0.7 | 0 | 0.2 | 0.9 | 6.2 | 7.0 |
| 290 A | 2.2 | 1.5 | 50 | 1.0 | 1.3 | 0.6 | 0 | 2.9 | 6.3 | 4.5 |
| 291 A | 3.5 | 0 | 0.9 | 0.9 | 1.3 | 0 | 1.0 | 2.4 | 7.6 | 4.1 |
| 292 A | 1.6 | 1.9 | 0.9 | 1.3 | 1.6 | 1.5 | 1.6 | 2.5 | 4.3 | 1.9 |
| 293 A | 2.2 | 1.2 | 16.3 | 0 | 2.2 | 0.1 | 0.8 | 3.3 | 10.6 | 8.3 |
| 294 A | 2.7 | 0 | 1.6 | 0.9 | 1.3 | 1.9 | 1.6 | 2.4 | 9.0 | 5.4 |
| 295 A | 2.3 | 3.3 | 50 | 1.6 | 3.6 | 3.8 | 7.9 | 10.1 | 20 | 20 |
| 296 A | 4.7 | 1.7 | 50 | 2.1 | 2.5 | 1.8 | 14.0 | 50 | 7.7 | 4.7 |
| 297 A | 2.4 | 1.1 | 50 | 0.9 | 0 | 0.8 | 1.1 | 1.5 | 7.3 | 4.3 |
| 298 A | 8.5 | 5.2 | 50 | 6.2 | 6.3 | 4.4 | 12.0 | 50 | 12.5 | 10.6 |
| 299 A | 3.3 | 0.1 | 50 | 20 | 3.4 | 0.7 | 0 | 0.4 | 50 | 1.7 |
| 300 A | 3.7 | 4.4 | 50 | 5.4 | 7.9 | 5.7 | 7.2 | 12.7 | 5.8 | 0.4 |
| 301 A | 1.7 | 0.5 | 50 | 0.3 | 0.9 | 2.5 | 3.1 | 9.8 | 20 | 20 |
| 302 A | 2.7 | 3.6 | 10.8 | 2.9 | 3.9 | 3.6 | 2.1 | 0 | 20 | 20 |
| 303 A | 4.6 | 2.7 | 1.6 | 4.8 | 4.9 | 1.3 | 0.7 | 1.0 | 20 | 20 |
| 304 A | 9.3 | 2.8 | 20 | 11.2 | 9.4 | 0 | 2.5 | 4.1 | 20 | 20 |
| 305 A | 3.0 | 0.6 | 12.6 | 4.5 | 3.8 | 1.8 | 1.0 | 0 | 20 | 20 |
| 306 A | 6.3 | 6.0 | 15.0 | 7.3 | 15.4 | 5.9 | 4.2 | 5.6 | 20 | 2.5 |
| 307 A | 3.0 | 1.8 | 0 | 1.6 | 2.4 | 1.6 | 1.0 | 0.8 | 9.5 | 1.4 |
| 308 A | 20 | 10.2 | 50 | 13.4 | 20 | 4.4 | 4.4 | 1.7 | 20 | 20 |
| 309 A | 3.2 | 0 | 0.3 | 1.3 | 0.4 | 1.6 | 1.3 | 0.8 | 5.8 | 3.4 |
| 310 A | 3.4 | 1.1 | 0 | 3.7 | 7.5 | 0.7 | 0.5 | 3.3 | 14.8 | 18.9 |
| 311 A | 1.9 | 0 | 0.7 | 0.9 | 1.2 | 0.5 | 0 | 1.2 | 2.6 | 1.8 |
| 312 A | 2.5 | 1.1 | 50 | 3.0 | 3.0 | 0.6 | 5.5 | 9.6 | 16.0 | 20 |
| 313 A | 2.7 | 6.6 | 50 | 4.8 | 6.3 | 5.7 | 4.5 | 9.9 | 1.3 | 0.9 |
| 314 A | 2.9 | 4.0 | 50 | 3.2 | 2.5 | 3.9 | 3.6 | 5.7 | 17.5 | 20 |
| 315 A | 4.8 | 1.9 | 50 | 3.3 | 4.6 | 1.7 | 8.9 | 50 | 13.0 | 12.0 |
| 316 A | 9.4 | 9.5 | 50 | 8.8 | 9.2 | 9.2 | 50 | 50 | 11.9 | 16.6 |
| 317 A | 3.5 | 5.0 | 50 | 3.6 | 1.5 | 3.1 | 5.2 | 6.8 | 20 | 7.4 |
| 318 A | 3.4 | 2.2 | 17.5 | 1.6 | 2.7 | 1.1 | 0 | 3.4 | 20 | 20 |
| 319 A | 7.1 | 8.2 | 20 | 8.9 | 12.7 | 7.7 | 5.8 | 3.8 | 8.7 | 0.9 |
| 320 A | 2.2 | 4.2 | 8.4 | 1.7 | 1.4 | 1.5 | 0.6 | 1.0 | 20 | 20 |
| 321 A | 20 | 20 | 20 | 20 | 20 | 2.2 | 8.6 | 18.8 | 20 | 20 |
| 322 A | 2.5 | 4.1 | 50 | 2.8 | 3.0 | 3.1 | 1.6 | 0 | 20 | 20 |
| 323 A | 5.7 | 8.7 | 50 | 9.3 | 20 | 4.9 | 2.5 | 0 | 20 | 20 |
| 324 A | 2.4 | 0.4 | 50 | 1.0 | 2.6 | 0.7 | 1.3 | 1.3 | 8.7 | 0.3 |
| 325 A | 20 | 0 | 13.3 | 6.3 | 20 | 5.1 | 3.7 | 3.4 | 20 | 20 |
| 326 A | 4.2 | 1.1 | 0 | 1.7 | 2.1 | 1.5 | 4.5 | 9.4 | 5.1 | 3.3 |
| 327 A | 4.3 | 3.8 | 20 | 3.2 | 2.8 | 1.8 | 0 | 3.3 | 18.3 | 12.6 |
| 328 A | 10.4 | 4.3 | 50 | 1.7 | 6.0 | 2.9 | 8.3 | 5.9 | 50 | 50 |
| 329 A | 3.5 | 0.1 | 0.3 | 0.6 | 1.4 | 0 | 1.1 | 2.2 | 6.6 | 3.7 |
| 330 A | 3.0 | 0.3 | 20 | 0.5 | 1.1 | 0 | 0.1 | 2.2 | 6.0 | 3.4 |
| 331 A | 6.4 | 6.1 | 0 | 8.0 | 7.9 | 1.4 | 6.4 | 4.6 | 6.5 | 6.8 |
| 332 A | 2.9 | 2.8 | 50 | 0 | 3.7 | 2.8 | 1.8 | 1.3 | 12.6 | 9.4 |
| 333 A | 3.0 | 2.9 | 3.6 | 1.1 | 2.9 | 1.7 | 1.2 | 4.8 | 8.0 | 8.4 |
| 334 A | 3.0 | 2.5 | 2.8 | 1.5 | 0 | 2.8 | 1.6 | 1.5 | 4.1 | 7.9 |
| 335 A | 2.1 | 1.2 | 2.1 | 1.0 | 0.2 | 0.8 | 0 | 0.9 | 5.1 | 4.8 |
| 336 A | 1.6 | 1.3 | 20 | 0.1 | 2.6 | 1.1 | 0.4 | 0.3 | 12.3 | 13.9 |
| 337 A | 5.6 | 5.0 | 12.7 | 6.7 | 7.3 | 0 | 10.5 | 50 | 20 | 20 |
| 338 A | 5.9 | 5.5 | 5.8 | 6.4 | 4.6 | 5.8 | 6.8 | 6.9 | 20 | 20 |
| 339 A | 2.7 | 1.5 | 1.0 | 0.8 | 0.4 | 1.3 | 1.2 | 0.4 | 6.6 | 2.4 |
| 340 A | 2.1 | 1.0 | 1.0 | 0 | 1.1 | 0.6 | 1.2 | 3.1 | 7.8 | 2.2 |
| 237 B | 1.7 | 0.5 | 0.3 | 0 | 0.4 | 0.3 | 1.0 | 7.3 | 5.4 | |
| 238 B | 11.6 | 7.3 | 0 | 7.8 | 20 | 1.9 | 4.7 | 2.7 | 20 | 20 |
| 239 B | 2.5 | 0.2 | 9.3 | 0.8 | 0.3 | 0.4 | 1.7 | 2.7 | 4.8 | 2.1 |
| 240 B | 10.2 | 2.7 | 1.3 | 9.7 | 20 | 2.8 | 0.6 | 0.7 | 20 | 20 |
| 241 B | 2.4 | 1.5 | 8.5 | 1.2 | 1.9 | 0 | 1.3 | 5.3 | 4.3 | 1.3 |

TABLE 60-continued

| | | | | | | | | | | |
|---|---|---|---|---|---|---|---|---|---|---|
| 242 B | 8.7 | 5.9 | 3.9 | 10.6 | 19.9 | 5.0 | 5.6 | 4.2 | 20 | 20 |
| 243 B | 2.3 | 0.4 | 50 | 0 | 0.5 | 0.3 | 0.6 | 4.5 | 4.3 | 0.7 |
| 244 B | 3.3 | 3.5 | 0.3 | 1.0 | 1.2 | 1.2 | 1.4 | 0.5 | 7.3 | 7.2 |
| 245 B | 20 | 20 | 0 | 20 | 20 | 3.0 | 19.4 | 20 | 20 | 20 |
| 246 B | 3.2 | 0 | 0.3 | 2.1 | 1.5 | 1.5 | 1.7 | 1.9 | 6.0 | 3.1 |
| 247 B | 7.9 | 12.4 | 0 | 6.3 | 9.1 | 0.9 | 0.8 | 3.0 | 20 | 20 |
| 248 B | 2.9 | 3.8 | 2.1 | 2.7 | 2.5 | 2.3 | 1.2 | 2.1 | 20 | 20 |
| 249 B | 3.3 | 3.8 | 50 | 1.6 | 4.1 | 4.4 | 8.4 | 50 | 6.6 | 4.6 |
| 250 B | 6.1 | 2.2 | 50 | 6.7 | 6.1 | 1.3 | 0.6 | 0 | 20 | 20 |
| 251 B | 3.3 | 5.3 | 50 | 9.3 | 5.4 | 5.9 | 3.3 | 4.5 | 50 | 0 |
| 252 B | 0 | 4.2 | 50 | 2.4 | 14.0 | 1.5 | 6.9 | 7.7 | 20 | 20 |
| 253 B | 2.2 | 3.0 | 50 | 3.3 | 2.4 | 1.6 | 1.5 | 2.3 | 6.5 | 5.3 |
| 254 B | 3.9 | 3.1 | 50 | 3.4 | 5.1 | 0.3 | 5.6 | 6.6 | 10 | 8.7 |
| 255 B | 1.5 | 2.6 | 50 | 1.6 | 0 | 1.7 | 1.0 | 13.6 | 4.8 | 20 |
| 256 B | 2.6 | 0 | 2.4 | 0.5 | 0.2 | 0.7 | 1.5 | 2.8 | 5.9 | 2.9 |
| 257 B | 20 | 20 | 0 | 16.5 | 20 | 4.2 | 20 | 20 | 50 | 50 |
| 258 B | 1.8 | 2.1 | 16.2 | 2.9 | 3.0 | 0.7 | 4.5 | 11.7 | 20 | 1.6 |
| 259 B | 15.5 | 7.5 | 50 | 8.8 | 20 | 5.3 | 2.0 | 0 | 20 | 20 |
| 260 B | 3.5 | 2.7 | 4.1 | 0.3 | 1.3 | 2.5 | 2.0 | 1.6 | 15.9 | 20 |
| 261 B | 20 | 20 | 50 | 20 | 20 | 3.5 | 20 | 20 | 20 | 20 |
| 262 B | 20 | 3.5 | 50 | 14.9 | 19.5 | 1.9 | 1.6 | 0 | 20 | 20 |
| 263 B | 8.9 | 4.7 | 50 | 15.3 | 19.2 | 5.7 | 3.1 | 0 | 20 | 20 |
| 264 B | 4.0 | 2.5 | 5.0 | 1.5 | 3.1 | 2.4 | 1.6 | 0.4 | 20 | 20 |
| 265 B | 2.4 | 0.9 | 50 | 0.3 | 0.7 | 1.6 | 11.4 | 18.0 | 5.0 | 2.2 |
| 266 B | 19.7 | 6.2 | 50 | 17.2 | 20 | 5.8 | 4.1 | 0 | 50 | 50 |
| 267 B | 3.6 | 2.7 | 0 | 1.4 | 1.9 | 2.3 | 1.8 | 3.2 | 5.2 | 2.5 |
| 268 B | 2.7 | 1.8 | 3.2 | 0.9 | 1.1 | 1.4 | 1.2 | 2.8 | 8.4 | 6.4 |
| 269 B | 3.2 | 0 | 5.3 | 0.8 | 1.6 | 0.8 | 1.0 | 1.8 | 5.6 | 3.1 |
| 270 B | 3.8 | 2.9 | 15.5 | 4.0 | 3.5 | 1.0 | 1.4 | 7.0 | 6.6 | 3.1 |
| 271 B | 6.0 | 4.0 | 0 | 7.6 | 5.3 | 1.3 | 2.9 | 6.2 | 5.0 | 3.6 |
| 272 B | 3.1 | 0.6 | 17.4 | 0.1 | 1.0 | 0.3 | 1.0 | 0.6 | 3.7 | 3.0 |
| 273 B | 9.8 | 4.2 | 50 | 20 | 20 | 1.5 | 0 | 2.5 | 20 | 20 |
| 274 B | 3.1 | 0.6 | 50 | 0 | 0.5 | 0.9 | 1.3 | 1.1 | 2.8 | 2.4 |
| 275 B | 6.8 | 8.0 | 7.1 | 7.2 | 13.0 | 8.2 | 7.1 | 7.4 | 10.7 | 2.0 |
| 276 B | 2.7 | 0.1 | 19.6 | 1.1 | 1.7 | 0.5 | 5.9 | 8.8 | 20 | 20 |
| 277 B | 7.5 | 10.9 | 6.8 | 9.3 | 14.0 | 10 | 9.5 | 11.0 | 0 | 20 |
| 278 B | 1.7 | 3.0 | 18.1 | 0.3 | 2.4 | 1.2 | 0.3 | 10.3 | 7.5 | 0.3 |
| 279 B | 3.6 | 4.5 | 20 | 1.0 | 4.1 | 4.5 | 2.9 | 2.0 | 20 | 20 |
| 280 B | 4.0 | 0.2 | 50 | 3.1 | 3.6 | 3.0 | 8.8 | 12.1 | 13.9 | 12.7 |
| 281 B | 50 | 50 | 50 | 50 | 50 | 50 | 50 | 50 | 50 | 50 |
| 282 B | 2.9 | 0.2 | 50 | 0.3 | 0.3 | 0 | 0.3 | 0 | 5.6 | 2.4 |
| 283 B | 2.0 | 3.2 | 0.4 | 0.7 | 0.8 | 0.6 | 1.5 | 2.7 | 8.3 | 7.5 |
| 284 B | 2.9 | 3.2 | 50 | 2.6 | 2.2 | 2.7 | 1.4 | 0 | 13.3 | 20 |
| 285 B | 2.9 | 0 | 1.6 | 0.5 | 0.7 | 0 | 0.2 | 2.2 | 4.8 | 1.9 |
| 286 B | 2.4 | 0.2 | 8.3 | 0.4 | 1.0 | 0.7 | 0.8 | 1.0 | 5.4 | 3.4 |
| 287 B | 4.6 | 1.1 | 14.1 | 8.2 | 9.1 | 3.5 | 3.2 | 10.7 | 1.1 | 1.4 |
| 288 B | 2.0 | 0.3 | 5.7 | 0.6 | 0.4 | 0 | 0.5 | 1.7 | 5.8 | 2.3 |
| 289 B | 1.3 | 1.1 | 0.7 | 0.5 | 0.2 | 0.2 | 0.2 | 0.4 | 6.7 | 5.4 |
| 290 B | 1.8 | 1.3 | 50 | 0.6 | 1.2 | 0.7 | 0 | 2.4 | 5.7 | 4.3 |
| 291 B | 3.4 | 0.2 | 0.8 | 0.7 | 1.2 | 0 | 0.8 | 2.6 | 7.6 | 3.9 |
| 292 B | 1.8 | 2.4 | 1.3 | 1.6 | 1.5 | 1.8 | 2.0 | 2.6 | 4.5 | 2.0 |
| 293 B | 2.4 | 1.1 | 15.9 | 0 | 2.3 | 0.2 | 0.9 | 2.8 | 9.3 | 8.6 |
| 294 B | 2.4 | 0 | 1.3 | 0.9 | 1.3 | 1.5 | 1.3 | 2.2 | 8.4 | 6.2 |
| 295 B | 2.4 | 3.4 | 50 | 1.8 | 3.8 | 3.6 | 7.2 | 8.7 | 20 | 18.4 |
| 296 B | 5.5 | 2.5 | 50 | 2.9 | 3.3 | 2.6 | 11.3 | 50 | 8.5 | 5.4 |
| 297 B | 2.3 | 0.9 | 50 | 1.0 | 0 | 0.8 | 0.8 | 1.3 | 7.0 | 4.1 |
| 298 B | 7.8 | 4.5 | 50 | 5.5 | 5.4 | 3.3 | 9.6 | 50 | 11.9 | 9.6 |
| 299 B | 2.3 | 0.9 | 50 | 15.0 | 1.8 | 1.8 | 1.1 | 2.3 | 20 | 1.6 |
| 300 B | 2.8 | 3.2 | 50 | 4.3 | 5.9 | 4.6 | 3.1 | 10.9 | 5.7 | 0 |
| 301 B | 1.7 | 0.7 | 50 | 0 | 0.6 | 2.4 | 2.7 | 7.1 | 20 | 20 |
| 302 B | 2.9 | 4.8 | 20 | 2.8 | 5.0 | 3.7 | 2.1 | 0 | 20 | 20 |
| 303 B | 4.9 | 2.3 | 0.9 | 5.3 | 6.4 | 0.4 | 0 | 0.2 | 20 | 20 |
| 304 B | 12.1 | 2.6 | 16.4 | 14.1 | 12.0 | 0 | 1.7 | 3.6 | 20 | 20 |
| 305 B | 2.9 | 0.7 | 14.7 | 4.2 | 3.3 | 1.7 | 0.9 | 0 | 20 | 20 |
| 306 B | 6.0 | 6.0 | 12.2 | 6.9 | 14.6 | 6.2 | 4.5 | 5.5 | 20 | 1.9 |
| 307 B | 3.0 | 2.1 | 0 | 1.7 | 2.3 | 1.7 | 1.1 | 0.8 | 9.7 | 1.5 |
| 308 B | 20 | 11.7 | 50 | 10.8 | 20 | 5.6 | 4.5 | 2.5 | 20 | 20 |
| 309 B | 3.2 | 0 | 0.2 | 1.2 | 0.4 | 1.6 | 1.3 | 0.8 | 5.8 | 3.3 |
| 310 B | 3.7 | 1.2 | 0 | 4.1 | 10.5 | 1.2 | 0.6 | 4.6 | 11.6 | 13.6 |
| 311 B | 1.8 | 0 | 1.7 | 0.8 | 1.0 | 0.4 | 0 | 1.4 | 2.3 | 1.0 |
| 312 B | 2.7 | 1.5 | 50 | 6.8 | 4.0 | 0.5 | 7.1 | 9.7 | 20 | 20 |
| 313 B | 2.9 | 7.7 | 50 | 5.1 | 7.1 | 6.0 | 4.8 | 7.2 | 1.6 | 1.4 |
| 314 B | 3.0 | 4.0 | 50 | 3.4 | 4.0 | 3.9 | 3.6 | 5.9 | 17.5 | 20 |
| 315 B | 5.6 | 2.5 | 50 | 5.8 | 5.9 | 2.0 | 11.4 | 18.0 | 13.7 | 11.8 |
| 316 B | 7.0 | 7.5 | 50 | 6.8 | 7.7 | 6.9 | 50 | 50 | 10 | 13.8 |
| 317 B | 3.4 | 4.4 | 50 | 3.2 | 1.3 | 2.2 | 6.6 | 6.4 | 20 | 7.6 |
| 318 B | 3.7 | 2.4 | 13.4 | 1.7 | 3.0 | 1.1 | 0 | 3.4 | 19.3 | 20 |
| 319 B | 6.9 | 8.0 | 50 | 9.5 | 13.1 | 7.4 | 5.5 | 3.6 | 10.4 | 0.8 |
| 320 B | 2.0 | 3.9 | 12.6 | 1.8 | 1.2 | 1.6 | 0.7 | 1.1 | 20 | 20 |

TABLE 60-continued

| | | | | | | | | | | |
|---|---|---|---|---|---|---|---|---|---|---|
| 321 B | 20 | 20 | 20 | 20 | 20 | 2.3 | 9.1 | 19.2 | 20 | 20 |
| 322 B | 3.0 | 4.6 | 50 | 2.7 | 2.7 | 3.5 | 2.0 | 0 | 20 | 20 |
| 323 B | 6.0 | 9.2 | 50 | 9.8 | 19.4 | 4.8 | 2.7 | 0 | 20 | 20 |
| 324 B | 2.4 | 1.3 | 11.1 | 1.0 | 2.7 | 0.9 | 1.2 | 3.4 | 2.5 | 1.2 |
| 325 B | 17.0 | 0.4 | 11.5 | 5.5 | 16.5 | 3.1 | 0 | 2.1 | 20 | 50 |
| 326 B | 3.5 | 0.1 | 0 | 1.2 | 1.3 | 0.7 | 2.4 | 3.4 | 6.4 | 2.4 |
| 327 B | 4.5 | 3.9 | 20 | 3.5 | 3.7 | 1.4 | 0 | 2.8 | 10.3 | 12.2 |
| 328 B | 15.1 | 6.0 | 50 | 3.7 | 6.2 | 5.5 | 18.4 | 50 | 20 | 50 |
| 329 B | 3.2 | 0 | 0.4 | 0.3 | 0.9 | 0 | 0.6 | 1.6 | 6.4 | 3.7 |
| 330 B | 3.0 | 0 | 20 | 0.6 | 1.3 | 0.1 | 0.3 | 1.8 | 6.0 | 3.7 |
| 331 B | 6.3 | 5.7 | 0 | 8.3 | 7.7 | 1.7 | 5.3 | 5.2 | 6.5 | 8.0 |
| 332 B | 2.5 | 2.6 | 50 | 0 | 2.4 | 2.3 | 1.3 | 0.9 | 15.3 | 6.6 |
| 333 B | 3.3 | 2.6 | 3.6 | 1.2 | 3.0 | 2.4 | 1.4 | 4.9 | 8.4 | 8.8 |
| 334 B | 2.9 | 2.6 | 2.8 | 1.5 | 0 | 2.7 | 1.6 | 1.4 | 5.5 | 10.8 |
| 335 B | 2.2 | 0.8 | 1.7 | 1.7 | 0.6 | 0.6 | 0 | 0.8 | 5.2 | 5.1 |
| 336 B | 1.9 | 1.5 | 20 | 0 | 3.0 | 1.5 | 0.5 | 0.4 | 14.2 | 19.6 |
| 337 B | 5.1 | 3.6 | 12.8 | 6.2 | 7.0 | 0 | 4.6 | 50 | 20 | 20 |
| 338 B | 5.7 | 6.0 | 5.8 | 6.8 | 4.9 | 5.4 | 6.4 | 6.7 | 20 | 20 |
| 339 B | 2.8 | 1.4 | 1.5 | 0.9 | 0.7 | 1.5 | 1.1 | 0.5 | 6.6 | 2.6 |
| 340 B | 1.9 | 0.6 | 1.0 | 0 | 1.0 | 0.2 | 1.0 | 2.3 | 7.0 | 1.8 |

SPA ™ technology; 1DN2 template structure; +carbohydrate

The results of the design calculations presented above in Tables 1-60 were used to construct a series of Fc variant libraries for experimental production and screening. Experimental libraries were designed in successive rounds of computational and experimental screening. Design of subsequent Fc libraries benefitted from feedback from prior libraries, and thus typically comprised combinations of Fc variants that showed favorable properties in the previous screen. The entire set of Fc variants that were constructed and experimentally tested is shown in Table 61. In this table, row 1 lists the variable positions, and the rows that follow indicate the amino acids at those variable positions for WT and the Fc variants. For example, variant 18 (SEQ ID NO:26) has the following four mutations: F241E, F243Y, V262T, and V264R. The variable position residues that compose this set of Fc variants are illustrated structurally in FIG. 4, and are presented in the context of the human IgG1 Fc sequence (SEQ ID NO:2) in FIG. 5.

TABLE 61

| Variant | SEQ ID NO | Substitution(s) |
|---|---|---|
| 1 | SEQ ID NO:9 | V264A |
| 2 | SEQ ID NO:10 | V264L |
| 3 | SEQ ID NO:11 | V264I |
| 4 | SEQ ID NO:12 | F241W |
| 5 | SEQ ID NO:13 | F241L |
| 6 | SEQ ID NO:14 | F243W |
| 7 | SEQ ID NO:15 | F243L |
| 8 | SEQ ID NO:16 | F241L/F243L/V262I/V264I |
| 9 | SEQ ID NO:17 | F241W/F243W |
| 10 | SEQ ID NO:18 | F241W/F243W/V262A/V264A |
| 11 | SEQ ID NO:19 | F241L/V262I |
| 12 | SEQ ID NO:20 | F243L/V264I |
| 13 | SEQ ID NO:21 | F243L/V262I/V264W |

TABLE 61-continued

| Variant | SEQ ID NO | Substitution(s) |
|---|---|---|
| 14 | SEQ ID NO:22 | F241Y/F243Y/V262T/V264T |
| 15 | SEQ ID NO:23 | F241E/F243R/V262E/V264R |
| 16 | SEQ ID NO:24 | F241E/F243Q/V262T/V264E |
| 17 | SEQ ID NO:25 | F241R/F243Q/V262T/V264R |
| 18 | SEQ ID NO:26 | F241E/F243Y/V262T/V264R |
| 19 | SEQ ID NO:27 | L328M |
| 20 | SEQ ID NO:28 | L328E |
| 21 | SEQ ID NO:29 | L328F |
| 22 | SEQ ID NO:30 | I332E |
| 23 | SEQ ID NO:31 | L328M/I332E |
| 24 | SEQ ID NO:32 | P244H |
| 25 | SEQ ID NO:33 | P245A |
| 26 | SEQ ID NO:34 | P247V |
| 27 | SEQ ID NO:35 | W313F |
| 28 | SEQ ID NO:36 | P244H/P245A/P247V |
| 29 | SEQ ID NO:37 | P247G |
| 30 | SEQ ID NO:38 | V264I/I332E |
| 31 | SEQ ID NO:39 | F241E/F243R/V262E/V264R/I332E |
| 32 | SEQ ID NO:40 | F241E/F243Q/V262T/V264E/I332E |
| 33 | SEQ ID NO:41 | F241R/F243Q/V262T/V264R/I332E |
| 34 | SEQ ID NO:42 | F241E/F243Y/V262T/V264R/I332E |
| 35 | SEQ ID NO:43 | S298A |
| 36 | SEQ ID NO:44 | S298A/I332E |
| 37 | SEQ ID NO:45 | S298A/E333A/K334A |

TABLE 61-continued

| Variant | SEQ ID NO | Substitution(s) |
|---|---|---|
| 41 | SEQ ID NO:46 | S239E/I332E |
| 42 | SEQ ID NO:47 | S239Q/I332E |
| 43 | SEQ ID NO:48 | S239E |
| 44 | SEQ ID NO:49 | D265G |
| 45 | SEQ ID NO:50 | D265N |
| 46 | SEQ ID NO:51 | S239E/D265G |
| 47 | SEQ ID NO:52 | S239E/D265N |
| 48 | SEQ ID NO:53 | S239E/D265Q |
| 49 | SEQ ID NO:54 | Y296E |
| 50 | SEQ ID NO:55 | Y296Q |
| 51 | SEQ ID NO:56 | S298T |
| 52 | SEQ ID NO:57 | S298N |
| 53 | SEQ ID NO:58 | T299I |
| 54 | SEQ ID NO:59 | A327S |
| 55 | SEQ ID NO:60 | A327N |
| 56 | SEQ ID NO:61 | S267Q/A327S |
| 57 | SEQ ID NO:62 | S267L/A327S |
| 58 | SEQ ID NO:63 | A327L |
| 59 | SEQ ID NO:64 | P329F |
| 60 | SEQ ID NO:65 | A330L |
| 61 | SEQ ID NO:66 | A330Y |
| 62 | SEQ ID NO:67 | I332D |
| 63 | SEQ ID NO:68 | N297S |
| 64 | SEQ ID NO:69 | N297D |
| 65 | SEQ ID NO:70 | N297S/I332E |
| 66 | SEQ ID NO:71 | N297D/I332E |
| 67 | SEQ ID NO:72 | N297E/I332E |
| 68 | SEQ ID NO:73 | D265Y/N297D/I332E |
| 69 | SEQ ID NO:74 | D265Y/N297D/T299L/I332E |
| 70 | SEQ ID NO:75 | D265F/N297E/I332E |
| 71 | SEQ ID NO:76 | L328I/I332E |
| 72 | SEQ ID NO:77 | L328Q/I332E |
| 73 | SEQ ID NO:78 | I332N |
| 74 | SEQ ID NO:79 | I332Q |
| 75 | SEQ ID NO:80 | V264T |
| 76 | SEQ ID NO:81 | V264F |
| 77 | SEQ ID NO:82 | V240I |
| 78 | SEQ ID NO:83 | V263I |
| 79 | SEQ ID NO:84 | V266I |
| 80 | SEQ ID NO:85 | T299A |
| 81 | SEQ ID NO:86 | T299S |
| 82 | SEQ ID NO:87 | T299V |
| 83 | SEQ ID NO:88 | N325Q |
| 84 | SEQ ID NO:89 | N325L |
| 85 | SEQ ID NO:90 | N325I |
| 86 | SEQ ID NO:91 | S239D |
| 87 | SEQ ID NO:92 | S239N |
| 88 | SEQ ID NO:93 | S239F |
| 89 | SEQ ID NO:94 | S239D/I332D |
| 90 | SEQ ID NO:95 | S239D/I332E |
| 91 | SEQ ID NO:96 | S239D/I332N |
| 92 | SEQ ID NO:97 | S239D/I332Q |
| 93 | SEQ ID NO:98 | S239E/I332D |
| 94 | SEQ ID NO:99 | S239E/I332N |
| 95 | SEQ ID NO:100 | S239E/I332Q |
| 96 | SEQ ID NO:101 | S239N/I332D |
| 97 | SEQ ID NO:102 | S239N/I332E |
| 98 | SEQ ID NO:103 | S239N/I332N |
| 99 | SEQ ID NO:104 | S239N/I332Q |
| 100 | SEQ ID NO:105 | S239Q/I332D |
| 101 | SEQ ID NO:106 | S239Q/I332N |
| 102 | SEQ ID NO:107 | S239Q/I332Q |
| 103 | SEQ ID NO:108 | K326E |
| 104 | SEQ ID NO:109 | Y296D |
| 105 | SEQ ID NO:110 | Y296N |
| 106 | SEQ ID NO:111 | N297D/I332E/F241Y/F243Y/V262T/V264T |
| 107 | SEQ ID NO:112 | I332E/A330Y |
| 108 | SEQ ID NO:113 | I332E/V264I/A330Y |
| 109 | SEQ ID NO:114 | I332E/A330L |
| 110 | SEQ ID NO:115 | I332E/V264I/A330L |
| 111 | SEQ ID NO:116 | L234D |
| 112 | SEQ ID NO:117 | L234E |
| 113 | SEQ ID NO:118 | L234N |
| 114 | SEQ ID NO:119 | L234Q |
| 115 | SEQ ID NO:120 | L234T |
| 116 | SEQ ID NO:121 | L234H |
| 117 | SEQ ID NO:122 | L234Y |
| 118 | SEQ ID NO:123 | L234I |
| 119 | SEQ ID NO:124 | L234V |
| 120 | SEQ ID NO:125 | L234F |
| 121 | SEQ ID NO:126 | L235D |
| 122 | SEQ ID NO:127 | L235S |
| 123 | SEQ ID NO:128 | L235N |
| 124 | SEQ ID NO:129 | L235Q |
| 125 | SEQ ID NO:130 | L235T |
| 126 | SEQ ID NO:131 | L235H |
| 127 | SEQ ID NO:132 | L235Y |
| 128 | SEQ ID NO:133 | L235I |
| 129 | SEQ ID NO:134 | L235V |
| 130 | SEQ ID NO:135 | L235F |
| 131 | SEQ ID NO:136 | S239T |
| 132 | SEQ ID NO:137 | S239H |
| 133 | SEQ ID NO:138 | S239Y |
| 134 | SEQ ID NO:139 | V240A |
| 135 | SEQ ID NO:140 | V240T |
| 136 | SEQ ID NO:141 | V240M |
| 137 | SEQ ID NO:142 | V263A |

TABLE 61-continued

| Variant | SEQ ID NO | Substitution(s) |
|---|---|---|
| 138 | SEQ ID NO:143 | V263T |
| 139 | SEQ ID NO:144 | V263M |
| 140 | SEQ ID NO:145 | V264M |
| 141 | SEQ ID NO:146 | V264Y |
| 142 | SEQ ID NO:147 | V266A |
| 143 | SEQ ID NO:148 | V266T |
| 144 | SEQ ID NO:149 | V266M |
| 145 | SEQ ID NO:150 | E269H |
| 146 | SEQ ID NO:151 | E269Y |
| 147 | SEQ ID NO:152 | E269F |
| 148 | SEQ ID NO:153 | E269R |
| 149 | SEQ ID NO:154 | Y296S |
| 150 | SEQ ID NO:155 | Y296T |
| 151 | SEQ ID NO:156 | Y296L |
| 152 | SEQ ID NO:157 | Y296I |
| 153 | SEQ ID NO:158 | S298H |
| 154 | SEQ ID NO:159 | T299H |
| 155 | SEQ ID NO:160 | A330V |
| 156 | SEQ ID NO:161 | A330I |
| 157 | SEQ ID NO:162 | A330F |
| 158 | SEQ ID NO:163 | A330R |
| 159 | SEQ ID NO:164 | A330H |
| 160 | SEQ ID NO:165 | N325D |
| 161 | SEQ ID NO:166 | N325E |
| 162 | SEQ ID NO:167 | N325A |
| 163 | SEQ ID NO:168 | N325T |
| 164 | SEQ ID NO:169 | N325V |
| 165 | SEQ ID NO:170 | N325H |
| 166 | SEQ ID NO:171 | L328D/I332E |
| 167 | SEQ ID NO:172 | L328E/I332E |
| 168 | SEQ ID NO:173 | L328N/I332E |
| 169 | SEQ ID NO:174 | L328Q/I332E |
| 170 | SEQ ID NO:175 | L328V/I332E |
| 171 | SEQ ID NO:176 | L328T/I332E |
| 172 | SEQ ID NO:177 | L328H/I332E |
| 173 | SEQ ID NO:178 | L328I/I332E |
| 174 | SEQ ID NO:179 | L328A |
| 175 | SEQ ID NO:180 | I332T |
| 176 | SEQ ID NO:181 | I332H |
| 177 | SEQ ID NO:182 | I332Y |
| 178 | SEQ ID NO:183 | I332A |
| 179 | SEQ ID NO:184 | V264I/I332E/S239E |
| 180 | SEQ ID NO:185 | V264I/I332E/S239Q |
| 181 | SEQ ID NO:186 | V264I/I332E/S239E/A330Y |
| 182 | SEQ ID NO:187 | V264I/I332E/S239E/A330Y/S298A |
| 183 | SEQ ID NO:188 | N297D/I332E/S239D |
| 184 | SEQ ID NO:189 | N297D/I332E/S239E |
| 185 | SEQ ID NO:190 | N297D/I332E/S239D/D265V |
| 186 | SEQ ID NO:191 | N297D/I332E/S239D/D265I |
| 187 | SEQ ID NO:192 | N297D/I332E/S239D/D265L |
| 188 | SEQ ID NO:193 | N297D/I332E/S239D/D265F |
| 189 | SEQ ID NO:194 | N297D/I332E/S239D/D265Y |
| 190 | SEQ ID NO:195 | N297D/I332E/S239D/D265H |
| 191 | SEQ ID NO:196 | N297D/I332E/S239D/D265T |
| 192 | SEQ ID NO:197 | N297D/I332E/V264E |
| 193 | SEQ ID NO:198 | N297D/I332E/Y296D |
| 194 | SEQ ID NO:199 | N297D/I332E/Y296E |
| 195 | SEQ ID NO:200 | N297D/I332E/Y296N |
| 196 | SEQ ID NO:201 | N297D/I332E/Y296Q |
| 197 | SEQ ID NO:202 | N297D/I332E/Y296H |
| 198 | SEQ ID NO:203 | N297D/I332E/Y296T |
| 199 | SEQ ID NO:204 | N297D/I332E/T299V |
| 200 | SEQ ID NO:205 | N297D/I332E/T299I |
| 201 | SEQ ID NO:206 | N297D/I332E/T299L |
| 202 | SEQ ID NO:207 | N297D/I332E/T299F |
| 203 | SEQ ID NO:208 | N297D/I332E/T299H |
| 204 | SEQ ID NO:209 | N297D/I332E/T299E |
| 205 | SEQ ID NO:210 | N297D/I332E/A330Y |
| 206 | SEQ ID NO:211 | N297D/I332E/S298A/A330Y |
| 207 | SEQ ID NO:212 | S239D/I332E/A330Y |
| 208 | SEQ ID NO:213 | S239N/I332E/A330Y |
| 209 | SEQ ID NO:214 | S239D/I332E/A330L |
| 210 | SEQ ID NO:215 | S239N/I332E/A330L |
| 211 | SEQ ID NO:216 | I332E/V264I/S298A |
| 212 | SEQ ID NO:217 | I332E/S239D/S298A |
| 213 | SEQ ID NO:218 | I332E/S239N/S298A |
| 214 | SEQ ID NO:219 | S239D/I332E/V264I |
| 215 | SEQ ID NO:220 | S239D/I332E/V264I/S298A |
| 216 | SEQ ID NO:221 | S239D/I332E/V264I/A330L |
| 217 | SEQ ID NO:222 | L328N |
| 218 | SEQ ID NO:223 | L328H |
| 219 | SEQ ID NO:224 | S239D/I332E/A330I |
| 220 | SEQ ID NO:225 | N297D/I332E/S239D/A330L |
| 221 | SEQ ID NO:226 | P230A |
| 222 | SEQ ID NO:227 | E233D |
| 223 | SEQ ID NO:228 | P230A/E233D |
| 224 | SEQ ID NO:229 | P230A/E233D/I332E |
| 225 | SEQ ID NO:230 | S267T |
| 226 | SEQ ID NO:231 | S267H |
| 227 | SEQ ID NO:232 | S267D |
| 228 | SEQ ID NO:233 | S267N |
| 229 | SEQ ID NO:234 | E269T |
| 230 | SEQ ID NO:235 | E269L |
| 231 | SEQ ID NO:236 | E269N |
| 232 | SEQ ID NO:237 | D270Q |
| 233 | SEQ ID NO:238 | D270T |
| 234 | SEQ ID NO:239 | D270H |
| 235 | SEQ ID NO:240 | E272S |
| 236 | SEQ ID NO:241 | E272K |
| 237 | SEQ ID NO:242 | E272I |
| 238 | SEQ ID NO:243 | E272Y |
| 239 | SEQ ID NO:244 | V273I |
| 240 | SEQ ID NO:245 | K274T |
| 241 | SEQ ID NO:246 | K274E |
| 242 | SEQ ID NO:247 | K274R |
| 243 | SEQ ID NO:248 | K274L |
| 244 | SEQ ID NO:249 | K274Y |
| 245 | SEQ ID NO:250 | F275W |
| 246 | SEQ ID NO:251 | N276S |
| 247 | SEQ ID NO:252 | N276E |
| 248 | SEQ ID NO:253 | N276R |
| 249 | SEQ ID NO:254 | N276L |
| 250 | SEQ ID NO:255 | N276Y |
| 251 | SEQ ID NO:256 | Y278T |
| 252 | SEQ ID NO:257 | Y278E |
| 253 | SEQ ID NO:258 | Y278K |
| 254 | SEQ ID NO:259 | Y278W |
| 255 | SEQ ID NO:260 | E283R |
| 256 | SEQ ID NO:261 | V302I |
| 257 | SEQ ID NO:262 | E318R |
| 258 | SEQ ID NO:263 | K320T |
| 259 | SEQ ID NO:264 | K320D |
| 260 | SEQ ID NO:265 | K320I |

TABLE 61-continued

| Variant | SEQ ID NO | Substitution(s) |
|---|---|---|
| 261 | SEQ ID NO:266 | K322T |
| 262 | SEQ ID NO:267 | K322H |
| 263 | SEQ ID NO:268 | V323I |
| 264 | SEQ ID NO:269 | S324T |
| 265 | SEQ ID NO:270 | S324D |
| 266 | SEQ ID NO:271 | S324R |
| 267 | SEQ ID NO:272 | S324I |
| 268 | SEQ ID NO:273 | S324V |
| 269 | SEQ ID NO:274 | S324L |
| 270 | SEQ ID NO:275 | S324Y |
| 271 | SEQ ID NO:276 | K326L |
| 272 | SEQ ID NO:277 | K326I |
| 273 | SEQ ID NO:278 | K326T |
| 274 | SEQ ID NO:279 | A327D |
| 275 | SEQ ID NO:280 | A327T |
| 276 | SEQ ID NO:281 | A330S |
| 277 | SEQ ID NO:282 | A330W |
| 278 | SEQ ID NO:283 | A330M |
| 279 | SEQ ID NO:284 | P331V |
| 280 | SEQ ID NO:285 | P331H |
| 281 | SEQ ID NO:286 | E333T |
| 282 | SEQ ID NO:287 | E333H |
| 283 | SEQ ID NO:288 | E333I |
| 284 | SEQ ID NO:289 | E333Y |
| 285 | SEQ ID NO:290 | K334I |
| 286 | SEQ ID NO:291 | K334T |
| 287 | SEQ ID NO:292 | K334F |
| 288 | SEQ ID NO:293 | T335D |
| 289 | SEQ ID NO:294 | T335R |
| 290 | | |
| 291 | | |
| 292 | | |
| 293 | | |
| 294 | | |
| 295 | | |
| 296 | | |
| 297 | | |
| 298 | | |
| 299 | | |
| 300 | | |
| 301 | | |
| 302 | | |
| 303 | | |

Example 2

Experimental Production and Screening of Fc Libraries

The majority of experimentation on the Fc variants was carried out in the context of the anti-cancer antibody alemtuzumab (Campath®, a registered trademark of Ilex Pharmaceuticals LP). Alemtuzumab binds a short linear epitope within its target antigen CD52 (Hale et al., 1990, *Tissue Antigens* 35:118-127; Hale, 1995, *Immunotechnology* 1:175-187). Alemtuzumab has been chosen as the primary engineering template because its efficacy is due in part to its ability to recruit effector cells (Dyer et al., 1989, *Blood* 73:1431-1439; Friend et al., 1991, *Transplant Proc* 23:2253-2254; Hale et al., 1998, *Blood* 92:4581-4590; Glennie et al., 2000, *Immunol Today* 21:403-410), and because production and use of its antigen in binding assays are relatively straightforward. In order to evaluate the optimized Fc variants of the present invention in the context of other antibodies, select Fc variants were evaluated in the anti-CD20 antibody rituximab (Rituxan®, a registered trademark of IDEC Pharmaceuticals Corporation), the anti-Her2 antibody trastuzumab (Herceptin®), a registered trademark of Genentech), and the anti-EGFR antibody cetuximab (Erbitux®, a registered trademark of Imclone). The use of alemtuzumab, rituximab, and trastuzumab for screening purposes is not meant to constrain the present invention to any particular antibody.

The IgG1 full length light ($V_L$-$C_L$) and heavy ($V_H$-C$\gamma$1-C$\gamma$2-C$\gamma$3) chain antibody genes for alemtuzumab, rituximab, and trastuzumab were constructed with convenient end restriction sites to facilitate subcloning. The genes were ligated into the mammalian expression vector pcDNA3.1Zeo (Invitrogen). The $V_H$-C$\gamma$1-C$\gamma$2-C$\gamma$3 clone in pcDNA3.1zeo was used as a template for mutagenesis of the Fc region. Mutations were introduced into this clone using PCR-based mutagenesis techniques. Fc variants were sequenced to confirm the fidelity of the sequence. Plasmids containing heavy chain gene ($V_H$-C$\gamma$1-C$\gamma$2-C$\gamma$3) (wild-type or variants) were co-transfected with plasmid containing light chain gene ($V_L$-$C_L$) into 293T cells. Media were harvested 5 days after transfection. Expression of immunoglobulin was monitored by screening the culture supernatant of transfectomas by western using peroxidase-conjugated goat-anti human IgG (Jackson ImmunoResearch, catalog # 109-035-088). FIG. 6 shows expression of wild-type alemtuzumab and variants 1 through 10 in 293T cells. Antibodies were purified from the supernatant using protein A affinity chromatography (Pierce, Catalog # 20334. FIG. 7 shows results of the protein purification for WT alemtuzumab. Antibody Fc variants showed similar expression and purification results to WT. Some Fc variants were deglycosylated in order to determine their solution and functional properties in the absence of carbohydrate. To obtain deglycosylated antibodies, purified alemtuzumab antibodies were incubated with peptide-N-glycosidase (PNGase F) at 37° C. for 24 h. FIG. 8 presents an SDS PAGE gel confirming deglycosylation for several Fc variants and WT alemtuzumab.

In order to confirm the functional fidelity of alemtuzumab produced under these conditions, the antigenic CD52 peptide, fused to GST, was expressed in E. coli BL21 (DE3) under IPTG induction. Both un-induced and induced samples were run on a SDS PAGE gel, and transferred to PVDF membrane. For western analysis, either alemtuzumab from Sotec (final concentration 2.5 ng/ul) or media of transfected 293T cells (final alemtuzumab concentration about 0.1-0.2 ng/ul) were used as primary antibody, and peroxidase-conjugated goat-anti human IgG was used as secondary antibody. FIG. 9 presents these results. The ability to bind target antigen confirms the structural and functional fidelity of the expressed alemtuzumab. Fc variants that have the same variable region as WT alemtuzumab are anticipated to maintain a comparable binding affinity for antigen.

In order to screen for Fc/Fc$\gamma$R binding, the extracellular regions of human V158 Fc$\gamma$RIIIa, human F158 Fc$\gamma$RIIIa, human Fc$\gamma$RIIb, human Fc$\gamma$RIIa, and mouse Fc$\gamma$RIII, were expressed and purified. FIG. 10 presents an SDS PAGE gel that shows the results of expression and purification of human V158 Fc$\gamma$RIIIa. The extracellular region of this receptor was obtained by PCR from a clone obtained from the Mammalian Gene Collection (MGC:22630). The receptor was fused with glutathione S-Transferase (GST) to enable screening. Tagged FcγRIIIa was transfected in 293T cells, and media containing secreted FcγRIIIa were harvested 3 days later and purified. For western analysis, membrane was probed with anti-GST antibody.

Binding affinity to FcγRIIIa and FcγRIIb was measured for all designed Fc variants using an AlphaScreen™ assay (Amplified Luminescent Proximity Homogeneous Assay (ALPHA), PerkinElmer, Wellesley, Mass.), a bead-based non-radioactive luminescent proximity assay. Laser excitation of a donor bead excites oxygen, which if sufficiently close to the acceptor bead generates a cascade of chemiluminescent events, ultimately leading to fluorescence emission at 520-620 nm. The AlphaScreen™ assay was applied as a competition assay for screening Fc variants. WT alemtuzumab antibody was biotinylated by standard methods for attachment to streptavidin donor beads, and GST-tagged FcγR was bound to glutathione chelate acceptor beads. In the absence of competing Fc variants, WT antibody and FcγR interact and produce a signal at 520-620 nm. Addition of untagged Fc variant competes with the WT Fc/FcγR interaction, reducing fluorescence quantitatively to enable determination of relative binding affinities. All Fc variants were screened for V158 FcγRIIIa binding using the AlphaScreen™ assay. Fc variants were screened in the context of either alemtuzumab or trastuzumab, and select Fc variants were also screened in the context of rituximab and cetuximab. Select Fc variants were subsequently screened for binding to FcγRIIb, as well as other FcγRs and Fc ligands.

FIG. 11 shows AlphaScreen™ data for binding to human V158 FcγRIIIa by select Fc variants. The binding data were normalized to the maximum and minimum luminescence signal for each particular curve, provided by the baselines at low and high antibody concentrations respectively. The data were fit to a one site competition model using nonlinear regression, and these fits are represented by the curves in the figure. These fits provide the inhibitory concentration 50% (IC50) (i.e. the concentration required for 50% inhibition) for each antibody, illustrated by the dotted lines in FIG. 11, thus enabling the relative binding affinities of Fc variants to be quantitatively determined. Here, WT alemtuzumab has an IC50 of $(4.63 \times 10^{-9}) \times (2) = 9.2$ nM, whereas S239D has an IC50 of $(3.98 \times 10^{-10}) \times (2) = 0.8$ nM. Thus S239D alemtuzumab binds 9.2 nM/0.8 nM=11.64-fold more tightly than WT alemtuzumab to human V158 FcγRIIIa. Similar calculations were performed for the binding of all Fc variants to human V158 FcγRIIIa. Select Fc variants were also screened for binding to human FcγRIIb, and examples of these AlphaScreen™ binding data are shown in FIG. 12. Table 62 presents the fold-enhancement or fold-reduction relative to the parent antibody for binding of Fc variants to human V158 FcγRIIIa (column 3) and human FcγRIIb (column 4), as determined by the AlphaScreen™ assay. For these data, a fold above 1 indicates an enhancement in binding affinity, and a fold below 1 indicates a reduction in binding affinity relative to WT Fc. Data for 1-206 and 217-218 were obtained in the context of alemtuzumab, except for those indicated with an asterix (*), which were tested in the context of trastuzumab. All data for 207-216 and 219-303 were obtained in the context of trastuzumab.

TABLE 62

| Variant | SEQ ID NO | Substitution(s) | FcγRIIIa Fold | FcγRIIb Fold | FcγIIIa-fold:FcγIIb-fold |
|---|---|---|---|---|---|
| 1 | SEQ ID NO:9 | V264A | 0.53 | | |
| 2 | SEQ ID NO:10 | V264L | 0.56 | | |
| 3 | SEQ ID NO:11 | V264I | 1.43 | | |
| 4 | SEQ ID NO:12 | F241W | 0.29 | | |
| 5 | SEQ ID NO:13 | F241L | 0.26 | | |
| 6 | SEQ ID NO:14 | F243W | 0.51 | | |
| 7 | SEQ ID NO:15 | F243L | 0.51 | | |
| 8 | SEQ ID NO:16 | F241L/F243L/V262I/V264I | 0.09 | | |
| 9 | SEQ ID NO:17 | F241W/F243W | 0.07 | | |
| 10 | SEQ ID NO:18 | F241W/F243W/V262A/V264A | 0.04 | | |
| 11 | SEQ ID NO:19 | F241L/V262I | 0.06 | | |
| 12 | SEQ ID NO:20 | F243L/V264I | 1.23 | | |
| 13 | SEQ ID NO:21 | F243L/V262I/V264W | 0.02 | | |
| 14 | SEQ ID NO:22 | F241Y/F243Y/V262T/V264T | 0.05 | | |
| 15 | SEQ ID NO:23 | F241E/F243R/V262E/V264R | 0.05 | | |
| 16 | SEQ ID NO:24 | F241E/F243Q/V262T/V264E | 0.07 | | |
| 17 | SEQ ID NO:25 | F241R/F243Q/V262T/V264R | 0.02 | | |
| 18 | SEQ ID NO:26 | F241E/F243Y/V262T/V264R | 0.05 | | |
| 19 | SEQ ID NO:27 | L328M | 0.21 | | |
| 20 | SEQ ID NO:28 | L328E | 0.12 | | |
| 21 | SEQ ID NO:29 | L328F | 0.24 | | |
| 22 | SEQ ID NO:30 | I332E | 6.72 | 3.93 | 1.71 |
| 23 | SEQ ID NO:31 | L328M/I332E | 2.60 | | |
| 24 | SEQ ID NO:32 | P244H | 0.83 | | |
| 25 | SEQ ID NO:33 | P245A | 0.25 | | |
| 26 | SEQ ID NO:34 | P247V | 0.53 | | |
| 27 | SEQ ID NO:35 | W313F | 0.88 | | |
| 28 | SEQ ID NO:36 | P244H/P245A/P247V | 0.93 | | |
| 29 | SEQ ID NO:37 | P247G | 0.54 | | |
| 30 | SEQ ID NO:38 | V264I/I332E | 12.49 | 1.57* | 7.96 |
| 31 | SEQ ID NO:39 | F241E/F243R/V262E/V264R/I332E | 0.19 | | |
| 32 | SEQ ID NO:40 | F241E/F243Q/V262T/V264E/I332E | | | |
| 33 | SEQ ID NO:41 | F241R/F243Q/V262T/V264R/I332E | | | |
| 34 | SEQ ID NO:42 | F241E/F243Y/V262T/V264R/I332E | 0.10 | | |
| 35 | SEQ ID NO:43 | S298A | 2.21 | | |

TABLE 62-continued

| Variant | SEQ ID NO | Substitution(s) | FcγRIIIa Fold | FcγRIIb Fold | FcγRIIIa-fold:FcγIIb-fold |
|---|---|---|---|---|---|
| 36 | SEQ ID NO:44 | S298A/I332E | 21.73 | | |
| 37 | SEQ ID NO:45 | S298A/E333A/K334A | 2.56 | | |
| 41 | SEQ ID NO:46 | S239E/I332E | 5.80 | 3.49 | 1.66 |
| 42 | SEQ ID NO:47 | S239Q/I332E | 6.60 | 4.68 | 1.41 |
| 43 | SEQ ID NO:48 | S239E | 10.16 | | |
| 44 | SEQ ID NO:49 | D265G | <0.02 | | |
| 45 | SEQ ID NO:50 | D265N | <0.02 | | |
| 46 | SEQ ID NO:51 | S239E/D265G | <0.02 | | |
| 47 | SEQ ID NO:52 | S239E/D265N | 0.02 | | |
| 48 | SEQ ID NO:53 | S239E/D265Q | 0.05 | | |
| 49 | SEQ ID NO:54 | Y296E | 0.73 | 1.11 | 0.66 |
| 50 | SEQ ID NO:55 | Y296Q | 0.52 | 0.43 | 1.21 |
| 51 | SEQ ID NO:56 | S298T | 0.94 | <0.02 | |
| 52 | SEQ ID NO:57 | S298N | 0.41 | <0.02 | |
| 53 | SEQ ID NO:58 | T299I | <0.02 | | |
| 54 | SEQ ID NO:59 | A327S | 0.23 | 0.39 | 0.59 |
| 55 | SEQ ID NO:60 | A327N | 0.19 | 1.15 | 0.17 |
| 56 | SEQ ID NO:61 | S267Q/A327S | 0.03 | | |
| 57 | SEQ ID NO:62 | S267L/A327S | <0.02 | | |
| 58 | SEQ ID NO:63 | A327L | 0.05 | | |
| 59 | SEQ ID NO:64 | P329F | <0.02 | | |
| 60 | SEQ ID NO:65 | A330L | 0.73 | 0.38 | 1.92 |
| 61 | SEQ ID NO:66 | A330Y | 1.64 | 0.75 | 2.19 |
| 62 | SEQ ID NO:67 | I332D | 17.80 | 3.34 | 5.33 |
| 63 | SEQ ID NO:68 | N297S | <0.02 | | |
| 64 | SEQ ID NO:69 | N297D | <0.02 | | |
| 65 | SEQ ID NO:70 | N297S/I332E | <0.02 | | |
| 66 | SEQ ID NO:71 | N297D/I332E | 0.08 | <0.02 | |
| 67 | SEQ ID NO:72 | N297E/I332E | <0.02 | | |
| 68 | SEQ ID NO:73 | D265Y/N297D/I332E | <0.02 | | |
| 69 | SEQ ID NO:74 | D265Y/N297D/T299L/I332E | <0.02 | | |
| 70 | SEQ ID NO:75 | D265F/N297E/I332E | <0.02 | | |
| 71 | SEQ ID NO:76 | L328I/I332E | 7.03 | | |
| 72 | SEQ ID NO:77 | L328Q/I332E | 1.54 | | |
| 73 | SEQ ID NO:78 | I332N | 0.39 | | |
| 74 | SEQ ID NO:79 | I332Q | 0.37 | | |
| 75 | SEQ ID NO:80 | V264T | 2.73 | | |
| 76 | SEQ ID NO:81 | V264F | 0.16 | | |
| 77 | SEQ ID NO:82 | V240I | 3.25 | | |
| 78 | SEQ ID NO:83 | V263I | 0.10 | | |
| 79 | SEQ ID NO:84 | V266I | 1.86 | | |
| 80 | SEQ ID NO:85 | T299A | 0.03 | | |
| 81 | SEQ ID NO:86 | T299S | 0.15 | | |
| 82 | SEQ ID NO:87 | T299V | <0.02 | | |
| 83 | SEQ ID NO:88 | N325Q | <0.02 | | |
| 84 | SEQ ID NO:89 | N325L | <0.02 | | |
| 85 | SEQ ID NO:90 | N325I | <0.02 | | |
| 86 | SEQ ID NO:91 | S239D | 11.64 | 4.47* | 2.60 |
| 87 | SEQ ID NO:92 | S239N | <0.02 | | |
| 88 | SEQ ID NO:93 | S239F | 0.22 | <0.02 | |
| 89 | SEQ ID NO:94 | S239D/I332D | 14.10 | | |
| 90 | SEQ ID NO:95 | S239D/I332E | 56.10 | 19.71* | 2.85 |
| 91 | SEQ ID NO:96 | S239D/I332N | 7.19 | | |
| 92 | SEQ ID NO:97 | S239D/I332Q | 9.28 | | |
| 93 | SEQ ID NO:98 | S239E/I332D | 9.33 | | |
| 94 | SEQ ID NO:99 | S239E/I332N | 11.93 | | |
| 95 | SEQ ID NO:100 | S239E/I332Q | 3.80 | | |
| 96 | SEQ ID NO:101 | S239N/I332D | 3.08 | | |
| 97 | SEQ ID NO:102 | S239N/I332E | 14.21 | | |
| 98 | SEQ ID NO:103 | S239N/I332N | 0.43 | | |
| 99 | SEQ ID NO:104 | S239N/I332Q | 0.56 | | |
| 100 | SEQ ID NO:105 | S239Q/I332D | 5.05 | | |
| 101 | SEQ ID NO:106 | S239Q/I332N | 0.39 | | |
| 102 | SEQ ID NO:107 | S239Q/I332Q | 0.59 | | |
| 103 | SEQ ID NO:108 | K326E | 3.85 | | |
| 104 | SEQ ID NO:109 | Y296D | 0.62 | | |
| 105 | SEQ ID NO:110 | Y296N | 0.29 | | |
| 106 | SEQ ID NO:111 | F241Y/F243Y/V262T/V264T/N297D/I332E | 0.15 | | |
| 107 | SEQ ID NO:112 | A330Y/I332E | 12.02 | 4.40 | 2.73 |
| 108 | SEQ ID NO:113 | V264I/A330Y/I332E | 12.00 | 3.54 | 3.39 |
| 109 | SEQ ID NO:114 | A330L/I332E | 10.34 | 2.03 | 5.09 |
| 110 | SEQ ID NO:115 | V264I/A330L/I332E | 11.15 | 1.79 | 6.23 |
| 111 | SEQ ID NO:116 | L234D | 0.21 | | |
| 112 | SEQ ID NO:117 | L234E | 1.34 | 2.21 | 0.61 |

TABLE 62-continued

| Variant | SEQ ID NO | Substitution(s) | FcγRIIIa Fold | FcγRIIb Fold | FcγRIIIa-fold:FcγIIb-fold |
|---|---|---|---|---|---|
| 113 | SEQ ID NO:118 | L234N | 0.56 | 1.39 | 0.40 |
| 114 | SEQ ID NO:119 | L234Q | 0.37 | | |
| 115 | SEQ ID NO:120 | L234T | 0.35 | | |
| 116 | SEQ ID NO:121 | L234H | 0.33 | | |
| 117 | SEQ ID NO:122 | L234Y | 1.42 | 1.08 | 1.31 |
| 118 | SEQ ID NO:123 | L234I | 1.55 | 1.14 | 1.36 |
| 119 | SEQ ID NO:124 | L234V | 0.38 | | |
| 120 | SEQ ID NO:125 | L234F | 0.30 | | |
| 121 | SEQ ID NO:126 | L235D | 1.66 | 3.63 | 0.46 |
| 122 | SEQ ID NO:127 | L235S | 1.25 | | |
| 123 | SEQ ID NO:128 | L235N | 0.40 | | |
| 124 | SEQ ID NO:129 | L235Q | 0.51 | | |
| 125 | SEQ ID NO:130 | L235T | 0.52 | | |
| 126 | SEQ ID NO:131 | L235H | 0.41 | | |
| 127 | SEQ ID NO:132 | L235Y | 1.19 | 10.15 | 0.12 |
| 128 | SEQ ID NO:133 | L235I | 1.10 | 0.94 | 1.17 |
| 129 | SEQ ID NO:134 | L235V | 0.48 | | |
| 130 | SEQ ID NO:135 | L235F | 0.73 | 3.53 | 0.21 |
| 131 | SEQ ID NO:136 | S239T | 1.34 | | |
| 132 | SEQ ID NO:137 | S239H | 0.20 | | |
| 133 | SEQ ID NO:138 | S239Y | 0.21 | | |
| 134 | SEQ ID NO:139 | V240A | 0.70 | 0.14 | 5.00 |
| 135 | SEQ ID NO:140 | V240T | | | |
| 136 | SEQ ID NO:141 | V240M | 2.06 | 1.38 | 1.49 |
| 137 | SEQ ID NO:142 | V263A | | | |
| 138 | SEQ ID NO:143 | V263T | 0.43 | | |
| 139 | SEQ ID NO:144 | V263M | 0.05 | | |
| 140 | SEQ ID NO:145 | V264M | 0.26 | | |
| 141 | SEQ ID NO:146 | V264Y | 1.02 | 0.27 | 3.78 |
| 142 | SEQ ID NO:147 | V266A | <0.02 | | |
| 143 | SEQ ID NO:148 | V266T | 0.45 | | |
| 144 | SEQ ID NO:149 | V266M | 0.62 | | |
| 145 | SEQ ID NO:150 | E269H | <0.02 | | |
| 146 | SEQ ID NO:151 | E269Y | 0.12 | | |
| 147 | SEQ ID NO:152 | E269F | 0.16 | | |
| 148 | SEQ ID NO:153 | E269R | 0.05 | | |
| 149 | SEQ ID NO:154 | Y296S | 0.12 | | |
| 150 | SEQ ID NO:155 | Y296T | <0.02 | | |
| 151 | SEQ ID NO:156 | Y296L | 0.22 | | |
| 152 | SEQ ID NO:157 | Y296I | 0.09 | | |
| 153 | SEQ ID NO:158 | A298H | 0.27 | | |
| 154 | SEQ ID NO:159 | T299H | <0.02 | | |
| 155 | SEQ ID NO:160 | A330V | 0.43 | | |
| 156 | SEQ ID NO:161 | A330I | 1.71 | 0.02 | 85.5 |
| 157 | SEQ ID NO:162 | A330F | 0.60 | | |
| 158 | SEQ ID NO:163 | A330R | <0.02 | | |
| 159 | SEQ ID NO:164 | A330H | 0.52 | | |
| 160 | SEQ ID NO:165 | N325D | 0.41 | | |
| 161 | SEQ ID NO:166 | N325E | <0.02 | | |
| 162 | SEQ ID NO:167 | N325A | 0.11 | | |
| 163 | SEQ ID NO:168 | N325T | 1.10 | | |
| 164 | SEQ ID NO:169 | N325V | 0.48 | | |
| 165 | SEQ ID NO:170 | N325H | 0.73 | | |
| 166 | SEQ ID NO:171 | L328D/I332E | 1.34 | | |
| 167 | SEQ ID NO:172 | L328E/I332E | 0.20 | | |
| 168 | SEQ ID NO:173 | L328N/I332E | <0.02 | | |
| 169 | SEQ ID NO:174 | L328Q/I332E | 0.70 | | |
| 170 | SEQ ID NO:175 | L328V/I332E | 2.06 | | |
| 171 | SEQ ID NO:176 | L328T/I332E | 1.10 | | |
| 172 | SEQ ID NO:177 | L328H/I332E | <0.02 | | |
| 173 | SEQ ID NO:178 | L328I/I332E | 3.49 | | |
| 174 | SEQ ID NO:179 | L328A | 0.20 | | |
| 175 | SEQ ID NO:180 | I332T | 0.72 | | |
| 176 | SEQ ID NO:181 | I332H | 0.46 | | |
| 177 | SEQ ID NO:182 | I332Y | 0.76 | | |
| 178 | SEQ ID NO:183 | I332A | 0.89 | | |
| 179 | SEQ ID NO:184 | S239E/V264I/I332E | 15.46 | | |
| 180 | SEQ ID NO:185 | S239Q/V264I/I332E | 2.14 | | |
| 181 | SEQ ID NO:186 | S239E/V264I/A330Y/I332E | 8.53 | | |
| 182 | SEQ ID NO:187 | S239E/V264I/S298A/A330Y/I332E | | | |
| 183 | SEQ ID NO:188 | S239D/N297D/I332E | 0.28 | | |
| 184 | SEQ ID NO:189 | S239E/N297D/I332E | 0.06 | | |
| 185 | SEQ ID NO:190 | S239D/D265V/N297D/I332E | 0.03 | | |
| 186 | SEQ ID NO:191 | S239D/D265I/N297D/I332E | 0.01 | | |
| 187 | SEQ ID NO:192 | S239D/D265L/N297D/I332E | <0.02 | | |

TABLE 62-continued

| Variant | SEQ ID NO | Substitution(s) | FcγRIIIa Fold | FcγRIIb Fold | FcγRIIIa-fold:FcγIIb-fold |
|---|---|---|---|---|---|
| 188 | SEQ ID NO:193 | S239D/D265F/N297D/I332E | <0.02 | | |
| 189 | SEQ ID NO:194 | S239D/D265Y/N297D/I332E | 0.02 | | |
| 190 | SEQ ID NO:195 | S239D/D265H/N297D/I332E | 0.04 | | |
| 191 | SEQ ID NO:196 | S239D/D265T/N297D/I332E | <0.02 | | |
| 192 | SEQ ID NO:197 | V264E/N297D/I332E | 0.05 | | |
| 193 | SEQ ID NO:198 | Y296D/N297D/I332E | | | |
| 194 | SEQ ID NO:199 | Y296E/N297D/I332E | <0.02 | | |
| 195 | SEQ ID NO:200 | Y296N/N297D/I332E | 0.04 | | |
| 196 | SEQ ID NO:201 | Y296Q/N297D/I332E | <0.02 | | |
| 197 | SEQ ID NO:202 | Y296H/N297D/I332E | <0.02 | | |
| 198 | SEQ ID NO:203 | Y296T/N297D/I332E | <0.02 | | |
| 199 | SEQ ID NO:204 | N297D/T299V/I332E | <0.02 | | |
| 200 | SEQ ID NO:205 | N297D/T299I/I332E | <0.02 | | |
| 201 | SEQ ID NO:206 | N297D/T299L/I332E | <0.02 | | |
| 202 | SEQ ID NO:207 | N297D/T299F/I332E | <0.02 | | |
| 203 | SEQ ID NO:208 | N297D/T299H/I332E | <0.02 | | |
| 204 | SEQ ID NO:209 | N297D/T299E/I332E | <0.02 | | |
| 205 | SEQ ID NO:210 | N297D/A330Y/I332E | 0.43 | | |
| 206 | SEQ ID NO:211 | N297D/S298A/A330Y/I332E | 0.16 | | |
| 207 | SEQ ID NO:212 | S239D/A330Y/I332E | 129.58 | | |
| 208 | SEQ ID NO:213 | S239N/A330Y/I332E | 14.22 | | |
| 209 | SEQ ID NO:214 | S239D/A330L/I332E | 138.63 | 7.50 | 18.48 |
| 210 | SEQ ID NO:215 | S239N/A330L/I332E | 12.95 | | |
| 211 | SEQ ID NO:216 | V264I/S298A/I332E | 16.50 | | |
| 212 | SEQ ID NO:217 | S239D/S298A/I332E | 295.16 | 6.16 | 47.92 |
| 213 | SEQ ID NO:218 | S239N/S298A/I332E | 32.14 | 5.15 | 6.24 |
| 214 | SEQ ID NO:219 | S239D/V264I/I332E | 36.58 | 14.39 | 2.54 |
| 215 | SEQ ID NO:220 | S239D/V264I/S298A/I332E | | | |
| 216 | SEQ ID NO:221 | S239D/V264I/A330L/I332E | | | |
| 217 | SEQ ID NO:222 | L328N | 0.59 | | |
| 218 | SEQ ID NO:223 | L328H | <0.02 | | |
| 219 | SEQ ID NO:224 | S239D/I332E/A330I | 59.1 | | |
| 220 | SEQ ID NO:225 | N297D/I332E/S239D/A330L | | | |
| 221 | SEQ ID NO:226 | P230A | 1.09 | | |
| 222 | SEQ ID NO:227 | E233D | 0.85 | | |
| 223 | SEQ ID NO:228 | P230A/E233D | 0.92 | | |
| 224 | SEQ ID NO:229 | P230A/E233D/I332E | 1.87 | | |
| 225 | SEQ ID NO:230 | S267T | | | |
| 226 | SEQ ID NO:231 | S267H | | | |
| 227 | SEQ ID NO:232 | S267D | | | |
| 228 | SEQ ID NO:233 | S267N | | | |
| 229 | SEQ ID NO:234 | E269T | <0.02 | | |
| 230 | SEQ ID NO:235 | E269L | <0.02 | | |
| 231 | SEQ ID NO:236 | E269N | <0.02 | | |
| 232 | SEQ ID NO:237 | D270Q | <0.02 | | |
| 233 | SEQ ID NO:238 | D270T | <0.02 | | |
| 234 | SEQ ID NO:239 | D270H | <0.02 | | |
| 235 | SEQ ID NO:240 | E272S | | | |
| 236 | SEQ ID NO:241 | E272K | | | |
| 237 | SEQ ID NO:242 | E272I | | | |
| 238 | SEQ ID NO:243 | E272Y | 8.70 | | |
| 239 | SEQ ID NO:244 | V273I | 0.79 | | |
| 240 | SEQ ID NO:245 | K274T | 1.41 | | |
| 241 | SEQ ID NO:246 | K274E | 6.11 | | |
| 242 | SEQ ID NO:247 | K274R | 1.41 | | |
| 243 | SEQ ID NO:248 | K274L | 1.09 | | |
| 244 | SEQ ID NO:249 | K274Y | 1.06 | | |
| 245 | SEQ ID NO:250 | F275W | 1.11 | | |
| 246 | SEQ ID NO:251 | N276S | 0.41 | | |
| 247 | SEQ ID NO:252 | N276E | 0.87 | | |
| 248 | SEQ ID NO:253 | N276R | 0.66 | | |
| 249 | SEQ ID NO:254 | N276L | 1.07 | | |
| 250 | SEQ ID NO:255 | N276Y | 0.56 | | |
| 251 | SEQ ID NO:256 | Y278T | 1.87 | | |
| 252 | SEQ ID NO:257 | Y278E | 0.90 | | |
| 253 | SEQ ID NO:258 | Y278K | | | |
| 254 | SEQ ID NO:259 | Y278W | 0.41 | | |
| 255 | SEQ ID NO:260 | E283R | 0.67 | | |
| 256 | SEQ ID NO:261 | V302I | 1.01 | | |
| 257 | SEQ ID NO:262 | E318R | 1.06 | | |
| 258 | SEQ ID NO:263 | K320T | | | |
| 259 | SEQ ID NO:264 | K320D | | | |
| 260 | SEQ ID NO:265 | K320I | | | |
| 261 | SEQ ID NO:266 | K322T | | | |
| 262 | SEQ ID NO:267 | K322H | | | |

TABLE 62-continued

| Variant | SEQ ID NO | Substitution(s) | FcγRIIIa Fold | FcγRIIb Fold | FcγIIIa-fold:FcγIIb-fold |
|---|---|---|---|---|---|
| 263 | SEQ ID NO:268 | V323I | 0.83 | | |
| 264 | SEQ ID NO:269 | S324T | | | |
| 265 | SEQ ID NO:270 | S324D | 1.07 | | |
| 266 | SEQ ID NO:271 | S324R | 0.71 | | |
| 267 | SEQ ID NO:272 | S324I | 1.15 | | |
| 268 | SEQ ID NO:273 | S324V | 1.17 | | |
| 269 | SEQ ID NO:274 | S324L | <0.02 | | |
| 270 | SEQ ID NO:275 | S324Y | 0.98 | | |
| 271 | SEQ ID NO:276 | K326L | | | |
| 272 | SEQ ID NO:277 | K326I | 1.43 | | |
| 273 | SEQ ID NO:278 | K326T | 1.88 | | |
| 274 | SEQ ID NO:279 | A327D | <0.02 | | |
| 275 | SEQ ID NO:280 | A327T | <0.02 | | |
| 276 | SEQ ID NO:281 | A330S | | | |
| 277 | SEQ ID NO:282 | A330W | | | |
| 278 | SEQ ID NO:283 | A330M | | | |
| 279 | SEQ ID NO:284 | P331V | | | |
| 280 | SEQ ID NO:285 | P331H | | | |
| 281 | SEQ ID NO:286 | E333T | 0.78 | | |
| 282 | SEQ ID NO:287 | E333H | 0.75 | | |
| 283 | SEQ ID NO:288 | E333I | | | |
| 284 | SEQ ID NO:289 | E333Y | | | |
| 285 | SEQ ID NO:290 | K334I | | | |
| 286 | SEQ ID NO:291 | K334T | | | |
| 287 | SEQ ID NO:292 | K334F | | | |
| 288 | SEQ ID NO:293 | T335D | 2.79 | | |
| 289 | SEQ ID NO:294 | T335R | 2.58 | | |
| 290 | SEQ ID NO:295 | T335Y | 1.56 | | |
| 291 | SEQ ID NO:296 | L234I/L235D | 0.07 | | |
| 292 | SEQ ID NO:297 | V240I/V266I | 1.72 | | |
| 293 | SEQ ID NO:298 | S239D/A330Y/I332E/L234I | 22.39 | | |
| 294 | SEQ ID NO:299 | S239D/A330Y/I332E/L235D | 7.04 | | |
| 295 | SEQ ID NO:300 | S239D/A330Y/I332E/V240I | 27.97 | | |
| 296 | SEQ ID NO:301 | S239D/A330Y/I332E/V264T | 17.72 | | |
| 297 | SEQ ID NO:302 | S239D/A330Y/I332E/V266I | | | |
| 298 | SEQ ID NO:303 | S239D/A330Y/I332E/K326E | 64.14 | | |
| 299 | SEQ ID NO:304 | S239D/A330Y/I332E/K326T | 59.03 | | |
| 300 | SEQ ID NO:305 | S239D/N297D/I332E/A330Y | <0.02 | | |
| 301 | SEQ ID NO:306 | S239D/N297D/I332E/A330Y/F241S/F243H/V262T/V264T | <0.02 | | |
| 302 | SEQ ID NO:307 | S239D/N297D/I332E/L235D | | | |
| 303 | SEQ ID NO:308 | S239D/N297D/I332E/K326E | | | |

Example 3

Selectively Enhanced Binding to FcγRs

A number of promising Fc variants with optimized properties were obtained from the FcγRIIIa and FcγRIIb screen. Table 62 provides Fc variants that bind more tightly to FcγRIIa, and thus are candidates for improving the effector function of antibodies and Fc fusions. These include a number of variants that comprise substitutions at 239, 264, 272, 274, 330, and 332. FIGS. 13a and 13b show AlphaScreen™ binding data for some of these Fc variants. The majority of these Fc variants provide substantially greater FcγRIIIa binding enhancements over S298A/E333A/K334A (SEQ ID NO:45).

Select Fc variants were screened in the context of multiple antibodies in order to investigate the breadth of their applicability. AlphaScreen™ data for binding of select Fc variants to human V158 FcγRIIIa in the context of trastuzumab, rituximab, and cetuximab are shown in FIGS. 14a, 14b, 15a, and 15b. Together with the data for alemtuzumab in FIG. 13, the results indicate consistent binding enhancements regardless of the antibody context, and thus that the Fc variants of the present invention are broadly applicable to antibodies and Fc fusions.

Fc variants have been obtained that show differentially enhanced binding to FcγRIIIa over FcγRIIb. As discussed, optimal effector function may result from Fc variants wherein affinity for activating FcγRs is greater than affinity for the inhibitory FcγRIIb. AlphaScreen™ data directly comparing binding to FcγRIIIa and FcγRIIb for two Fc variants with this specificity profile are shown in FIGS. 16a and 16b. This concept can be defined quantitatively as the fold-enhancement or -reduction of the activating FγR (Table 62, column 3) divided by the fold-enhancement or -reduction of the inhibitory FcγR (Table 62, column 4), herein referred to as the FcγRIIIa-fold:FcγRIIb-fold ratio. This value is provided in Column 5 in Table 62. Table 62 shows that Fc variants provide this specificity profile, with a FcγRIIa-fold:FcγRIIb-fold ratio as high as 86:1.

Some of the most promising Fc variants of the present invention for enhancing effector function have both substantial increases in affinity for FcγRγIIIa and favorable FcγRIIa-fold:FcγRIIb-fold ratios. These include, for example, S239D/I332E (SEQ ID NO:95) (FcγRIIIa-fold=56, FcγRIIIa-fold:FcγRIIb-fold=3), S239D/A330Y/I332E (SEQ ID NO:212) (FcγRIIIa-fold=130), S239D/A330L/I332E (SEQ ID NO:214) (FcγRIIIa-fold=139, FcγRIIIa-fold:FcγRIIb-fold=18), and S239D/S298A/I332E (SEQ ID NO:217) (FcγRIIIa-fold=295, FcγRIIIa-fold:FcγRIIb-fold=48). FIG. 17 shows AlphaScreen™ binding data for these and other Fc variants to human V158 FcγRIIIa.

Because there are a number of FcγRs that contribute to effector function, it may be worthwhile to additionally screen Fc variants against other receptors. FIG. 18 shows AlphaScreen™ data for binding of select Fc variants to human R131 FcγRIIa. As can be seen, those aforementioned variants with favorable binding enhancements and specificity profiles also show enhanced binding to this activating receptor. The use of FcγRIIIa, FcγRIIb, and FcγRIIc for screening is not meant to constrain experimental testing to these particular FcγRs; other FcγRs are contemplated for screening, including but not limited to the myriad isoforms and allotypes of FcγRI, FcγRII, and FcγRIII from humans, mice, rats, monkeys, and the like, as previously described.

Taken together, the FcγR binding data provided in FIGS. 11-18 and Table 62 indicate that a number of substitutions at positions 234, 235, 239, 240, 243, 264, 266, 272, 274, 278, 325, 328, 330, and 332 are promising candidates for improving the effector function of antibodies and Fc fusions. Because combinations of some of these substitutions have typically resulted in additive or synergistic binding improvements, it is anticipated that as yet unexplored combinations of the Fc variants provided in Table 62 will also provide favorable results. Thus all combinations of the Fc variants in Table 62 are contemplated. Likewise, combinations of any of the Fc variants in Table 62 with other discovered or undiscovered Fc variants may also provide favorable properties, and these combinations are also contemplated. Furthermore, it is anticipated from these results that other substitutions at positions 234, 235, 239, 240, 243, 264, 266, 325, 328, 330, and 332 may also provide favorable binding enhancements and specificities, and thus substitutions at these positions other than those presented in Table 62 are contemplated.

Example 4

Reduced Binding to FcγRs

As discussed, although there is a need for greater effector function, for some antibody therapeutics, reduced or eliminated effector function may be desired. Several Fc variants in Table 62 substantially reduce or ablate FcγR binding, and thus may find use in antibodies and Fc fusions wherein effector function is undesirable. AlphaScreen™ binding data for some examples of such variants are shown in FIGS. 19a and 19b. These Fc variants, as well as their use in combination, may find use for eliminating effector function when desired, for example in antibodies and Fc fusions whose mechanism of action involves blocking or antagonism but not killing of the cells bearing target antigen.

Example 5

Aglycosylated Fc Variants

As discussed, one goal of the current experiments was to obtain optimized aglycosylated Fc variants. Several Fc variants provide significant progress towards this goal. Because it is the site of glycosylation, substitution at N297 results in an aglycosylated Fc. Whereas all other Fc variants that comprise a substitution at N297 completely ablate FcγR binding, N297D/I332E (SEQ ID NO:71) has significant binding affinity for FcγRIIIa, shown in Table 62 and illustrated in FIG. 20. The exact reason for this result is uncertain in the absence of a high-resolution structure for this variant, although the computational screening predictions suggest that it is potentially due to a combination of new favorable Fc/FcγR interactions and favorable electrostatic properties. Indeed other electrostatic substitutions are envisioned for further optimization of aglycosylated Fc. Table 62 shows that other aglycosylated Fc variants such as S239D/N297D/I332E (SEQ ID NO:188) and N297D/A330Y/I332E (SEQ ID NO:210) provide binding enhancements that bring affinity for FcγRIIIa within 0.28- and 0.43-fold respectively of glycosylated WT alemtuzumab. Combinations of these variants with other Fc variants that enhance FcγR binding are contemplated, with the goal of obtaining aglycosylated Fc variants that bind one or more FcγRs with affinity that is approximately the same as or even better than glycosylated parent Fc. An additional set of promising Fc variants provide stability and solubility enhancements in the absence of carbohydrate. Fc variants that comprise substitutions at positions 241, 243, 262, and 264, positions that do not mediate FγR binding but do determine the interface between the carbohydrate and Fc, ablate FγR binding, presumably because they perturb the conformation of the carbohydrate. In deglycosylated form, however, Fc variants F241E/F243R/V262E/V264R (SEQ ID NO:23), F241E/F243Q/V262T/V264E (SEQ ID NO:24), F241R/F243Q/V262T/V264R (SEQ ID NO:25), and F241E/F243Y/V262T/V264R (SEQ ID NO:26) show stronger binding to FcγRIIIa than in glycosylated form, as shown by the AlphaScreen™ data in FIG. 21. This result indicates that these are key positions for optimization of the structure, stability, solubility, and function of aglycosylated Fc. Together these results suggests that protein engineering can be used to restore the favorable functional and solution properties of antibodies and Fc fusions in the absence of carbohydrate, and pave the way for aglycosylated antibodies and Fc fusions with favorable solution properties and full functionality that comprise substitutions at these and other Fc positions.

Example 6

Affinity of Fc Variants for Polymorphic Forms of FcγRIIIa

As discussed above, an important parameter of Fc-mediated effector function is the affinity of Fc for both V158 and F158 polymorphic forms of FcγRIIIa. AlphaScreen™ data comparing binding of select variants to the two receptor allotypes are shown in FIG. 22a (V158 FcγRIIIa) and FIG. 22b (F158 FcγRIIIa). As can be seen, all variants improve binding to both FcγRIIIa allotypes. These data indicate that those Fc variants of the present invention with enhanced effector function will be broadly applicable to the entire patient population, and that enhancement to clinical efficacy will potentially be greatest for the low responsive patient population who need it most.

The FcγR binding affinities of these Fc variants were further investigated using Surface Plasmon Resonance (SPR) (Biacore, Uppsala, Sweden). SPR is a sensitive and extremely quantitative method that allows for the measurement of binding affinities of protein-protein interactions, and has been used to effectively measure Fc/FcγR binding (Radaev et al., 2001, *J Biol Chem* 276:16478-16483). SPR thus provides an excellent complementary binding assay to the AlphaScreen™ assay. His-tagged V158 FcγRIIIa was immobilized to an SPR chip, and WT and Fc variant alemtuzumab antibodies were flowed over the chip at a range of concentrations. Binding constants were obtained from fitting the data using standard curve-fitting methods. Table 63 presents dissociation constants (Kd) for binding of select Fc variants to V158 FcγRIIIa and F158 FcγRIIIa obtained using SPR, and compares these with IC50s obtained from the AlphaScreen™ assay. By dividing the Kd and IC50 for each variant by that of WT alemtuzumab, the fold-improvements over WT (Fold) are obtained.

TABLE 63

| | SPR V158 FcγRIIIa | | SPR F158 FcγRIIIa | | AlphaScreen™ V158 FcγRIIIa | | AlphaScreen™ F158 FcγRIIIa | |
|---|---|---|---|---|---|---|---|---|
| | Kd (nM) | Fold | Kd (nM) | Fold | IC50 (nM) | Fold | IC50 (nM) | Fold |
| WT (SEQ ID NO:2) | 68 | | 730 | | 6.4 | | 17.2 | |
| V264I (SEQ ID NO:11) | 64 | 1.1 | 550 | 1.3 | 4.5 | 1.4 | 11.5 | 1.5 |
| I332E (SEQ ID NO:30) | 31 | 2.2 | 72 | 10.1 | 1.0 | 6.4 | 2.5 | 6.9 |
| V264I/I332E (SEQ ID NO:38) | 17 | 4.0 | 52 | 14.0 | 0.5 | 12.8 | 1.1 | 15.6 |
| S298A (SEQ ID NO:43) | 52 | 1.3 | 285 | 2.6 | 2.9 | 2.2 | 12.0 | 1.4 |
| S298A/E333A/K334A (SEQ ID NO:45) | 39 | 1.7 | 156 | 4.7 | 2.5 | 2.6 | 7.5 | 2.3 |

The SPR data corroborate the improvements to FcγRIIIa affinity observed by AlphaScreen™ assay. Table 63 further indicates the superiority of V264I/I332E (SEQ ID NO:38) and I332E (SEQ ID NO:30) over S298A (SEQ ID NO:43) and S298A/E333A/K334A (SEQ ID NO:45); whereas S298A/E333A/K334A (SEQ ID NO:45) improves Fc binding to V158 and F158 FcγRIIIa by 1.7-fold and 4.7-fold respectively, I332E (SEQ ID NO:30) shows binding enhancements of 2.2-fold and 10.1-fold respectively, and V264I/I332E (SEQ ID NO:38) shows binding enhancements of 4.0-fold and 14-fold respectively. Also worth noting is that the affinity of V264I/I332E (SEQ ID NO:38) for F158 FcγRIIIa (52 nM) is better than that of WT for the V158 allotype (68 nM), suggesting that this Fc variant, as well as those with even greater improvements in binding, may enable the clinical efficacy of antibodies for the low responsive patient population to achieve that currently possible for high responders. The correlation between the SPR and AlphaScreen™ binding measurements are shown in FIGS. 23a-23d. FIGS. 23a and 23b show the Kd-IC50 correlations for binding to V158 FcγRIIIa and F158 FcγRIIIa respectively, and FIGS. 23c and 23d show the fold-improvement correlations for binding to V158 FcγRIIIa and F158 FcγRIIIa respectively. The good fits of these data to straight lines ($r^2$=0.9, $r^2$=0.84, $r^2$=0.98, and $r^2$=0.90) support the accuracy the AlphaScreen™ measurements, and validate its use for determining the relative FcγR binding affinities of Fc variants.

SPR data were also acquired for binding of select trastuzumab Fc variants to human V158 FcγRIIIa, F158 FcγRIIIa, and FcγRIIb. These data are shown in Table 64. The Fc variants tested show substantial binding enhancements to the activating receptor FcγRIIIa, with over 100-fold tighter binding observed for interaction of S239D/I332E/S298A (SEQ ID NO:217) with F158 FcγRIIIa. Furthermore, for the best FcγRIIIa binders, F158 FcγRIIIa/FcγRIb ratios of 3-4 are observed.

TABLE 64

| | SPR V158 FcγRIIIa | | SPR F158 FcγRIIIa | | SPR FcγRIIb | |
|---|---|---|---|---|---|---|
| | Kd (nM) | Fold | Kd (nM) | Fold | IC50 (nM) | Fold |
| WT (SEQ ID NO:2) | 363.5 | | 503 | | 769 | |
| V264I/I332E (SEQ ID NO:38) | 76.9 | 4.7 | 252 | 2.0 | 756 | 1.0 |
| V264I/I332E/A330L (SEQ ID NO:115) | 113.0 | 3.2 | 88 | 5.7 | 353 | 2.2 |
| S239D/I332E/A330L (SEQ ID NO:214) | 8.2 | 44.3 | 8.9 | 56.5 | 46 | 16.7 |
| S239D/I332E/S298A (SEQ ID NO:217) | 8.7 | 41.8 | 4.9 | 102.7 | 32 | 24.0 |
| S239D/I332E/V264I/A330L (SEQ ID NO:221) | 12.7 | 28.6 | 6.3 | 79.8 | 35 | 22.0 |

Example 7

ADCC of Fc Variants

In order to determine the effect on effector function, cell-based ADCC assays were performed on select Fc variants. ADCC was measured using the DELFIA® EuTDA-based cytotoxicity assay (Perkin Elmer, MA) with purified human peripheral blood monocytes (PBMCs) as effector cells. Target cells were loaded with BATDA at 1×10⁶ cells/ml, washed 4 times and seeded into 96-well plate at 10,000 cells/well. The target cells were then opsonized using Fc variant or WT antibodies at the indicated final concentration. Human PBMCs, isolated from buffy-coat were added at the indicated fold-excess of target cells and the plate was incubated at 37° C. for 4 hrs. The co-cultured cells were centrifuged at 500×g, supernatants were transferred to a separate plate and incubated with Eu solution, and relative fluorescence units were measured using a Packard Fusion™ α-FP HT reader (Packard Biosciences, Ill.). Samples were run in triplicate to provide error estimates (n=3, +/−S.D.). PBMCs were allotyped for the V158 or F158 FcγRIIIa allotype using PCR.

ADCC assays were run on Fc variant and WT alemtuzumab using DoHH-2 lymphoma target cells. FIG. 24a is a bar graph showing the ADCC of these proteins at 10 ng/ml antibody. Results show that alemtuzumab Fc variants I332E (SEQ ID NO:30), V264I (SEQ ID NO:11), and I332E/V264I (SEQ ID NO:38) have substantially enhanced ADCC compared to WT alemtuzumab, with the relative ADCC enhancements proportional to their binding improvements to FcγRIIIa as indicated by AlphaScreen™ assay and SPR. The dose dependence of ADCC on antibody concentration is shown in FIG. 24b. The binding data were normalized to the minimum and maximum fluorescence signal for each particular curve, provided by the baselines at low and high antibody concentrations respectively. The data were fit to a sigmoidal dose-response model using nonlinear regression, represented by the curve in the figure. The fits enable determination of the effective concentration 50% (EC50) (i.e. the concentration required for 50% effectiveness), which provides the relative enhancements to ADCC for each Fc variant. The EC50s for these binding data are analogous to the IC50s obtained from the AlphaScreen™ competition data, and derivation of these values is thus analogous to that described in Example 2 and FIG. 11. In FIG. 24b, the log(EC50)s, obtained from the fits to the data, for WT (SEQ ID NO:2), V264I/I332E (SEQ ID NO:38), and S239D/I332E (SEQ ID NO:95) alemtuzumab are 0.99, 0.60, and 0.49 respectively, and therefore their respective EC50s are 9.9, 4.0, and 3.0. Thus V264I/I332E (SEQ ID NO:38) and S239E/I332E (SEQ ID NO:95) provide a 2.5-fold and 3.3-fold enhancement respectively in ADCC over WT alemtuzumab using PBMCs expressing heterozygous V158/F158 FcγRIIIa. These data are summarized in Table 65 below.

TABLE 65

|  | log(EC50) | EC50 (ng/ml) | Fold Improvement Over WT |
| --- | --- | --- | --- |
| WT (SEQ ID NO:2) | 0.99 | 9.9 |  |
| V264I/I332E (SEQ ID NO:38) | 0.60 | 4.0 | 2.5 |
| S239D/I332E (SEQ ID NO:95) | 0.49 | 3.0 | 3.3 |

In order to determine whether these ADCC enhancements are broadly applicable to antibodies, select Fc variants were evaluated in the context of trastuzumab and rituximab. ADCC assays were run on Fc variant and WT trastuzumab using two breast carcinoma target cell lines BT474 and Sk-Br-3. FIG. 25a shows a bar graph illustrating ADCC at 1 ng/ml antibody. Results indicate that V264I (SEQ ID NO:11) and V264I/I332E (SEQ ID NO:38) trastuzumab provide substantially enhanced ADCC compared to WT trastuzumab, with the relative ADCC enhancements proportional to their binding improvements to FcγRIIIa as indicated by AlphaScreen™ assay and SPR. FIGS. 25b and 25c show the dose dependence of ADCC on antibody concentration for select Fc variants. The EC50s obtained from the fits of these data and the relative fold-improvements in ADCC are provided in Table 66 below. Significant ADCC improvements are observed for I332E (SEQ ID NO:30) trastuzumab when combined with A330L (SEQ ID NO:65) and A330Y(SEQ ID NO:66). Furthermore, S239D/A330L/I332E (SEQ ID NO:214) provides a substantial ADCC enhancement, greater than 300-fold for PBMCs expressing homozygous F158/F158 FcγRIIa, relative to WT trastuzumab and S298A/K333A/K334A (SEQ ID NO:45), consistent with the FcγR binding data observed by the AlphaScreen™ assay and SPR.

TABLE 66

|  | log(EC50) | EC50 (ng/ml) | Fold Improvement Over WT |
| --- | --- | --- | --- |
| FIG. 25b |  |  |  |
| WT (SEQ ID NO:2) | 1.1 | 11.5 |  |
| I332E (SEQ ID NO:30) | 0.34 | 2.2 | 5.2 |
| A330Y/I332E (SEQ ID NO:112) | −0.04 | 0.9 | 12.8 |
| A330L/I332E (SEQ ID NO:114) | 0.04 | 1.1 | 10.5 |
| FIG. 25d |  |  |  |
| WT (SEQ ID NO:2) | −0.15 | 0.71 |  |
| S298A/E333A/K334A (SEQ ID NO:45) | −0.72 | 0.20 | 3.6 |
| S239D/A330L/I332E (SEQ ID NO:214) | −2.65 | 0.0022 | 323 |

ADCC assays were run on V264I/I332E (SEQ ID NO:38), WT (SEQ ID NO:2), and S298A/E333A/K334A (SEQ ID NO:45) rituximab using WIL2-S lymphoma target cells. FIG. 26a presents a bar graph showing the ADCC of these proteins at 1 ng/ml antibody. Results indicate that V264I/I332E (SEQ ID NO:38) rituximab provides substantially enhanced ADCC relative to WT rituximab, as well as superior ADCC to S298A/-E333A/K334A (SEQ ID NO:45), consistent with the FcγRIIIa binding improvements observed by AlphaScreen™ assay and SPR. FIGS. 26b and 26c show the dose dependence of ADCC on antibody concentration for select Fc variants. The EC50s obtained from the fits of these data and the relative fold-improvements in ADCC are provided in Table 67 below. As can be seen S239D/I332E/A330L (SEQ ID NO:214) rituximab provides greater than 900-fold enhancement in EC50 over WT for PBMCs expressing homozygous F158/F158 FcγRIIIa. The differences in ADCC enhancements observed for alemtuzumab, trastuzumab, and rituximab are likely due to the use of different PBMCs, different antibodies, and different target cell lines.

TABLE 67

|  | log(EC50) | EC50 (ng/ml) | Fold Improvement Over WT |
| --- | --- | --- | --- |
| FIG. 26b |  |  |  |
| WT (SEQ ID NO:2) | 0.23 | 1.7 |  |
| S298A/E333A/K334A (SEQ ID NO:45) | −0.44 | 0.37 | 4.6 |
| V264I/I332E (SEQ ID NO:38) | −0.83 | 0.15 | 11.3 |
| FIG. 26c |  |  |  |
| WT (SEQ ID NO:2) | 0.77 | 5.9 |  |
| S239D/I332E/A330L (SEQ ID NO:214) | −2.20 | 0.0063 | 937 |

Thus far, ADCC data has been normalized such that the lower and upper baselines of each Fc polypeptide are set to the minimal and maximal fluorescence signal for that specific Fc polypeptide, typically being the fluorescence signal at the lowest and highest antibody concentrations respectively. Although presenting the data in this matter enables a straightforward visual comparison of the relative EC50s of different antibodies (hence the reason for presenting them in this way), important information regarding the absolute level of effector function achieved by each Fc polypeptide is lost. FIGS. 27a and 27b present cell-based ADCC data for trastuzumab and rituximab respectively that have been normalized according to the absolute minimal lysis for the assay, provided by the fluorescence signal of target cells in the presence of PBMCs alone (no antibody), and the absolute maximal lysis for the assay, provided by the fluorescence signal of target cells in the presence of Triton X1000. The graphs show that the antibodies differ not only in their EC50, reflecting their relative potency, but also in the maximal level of ADCC attainable by the antibodies at saturating concentrations, reflecting their relative efficacy. Thus far these two terms, potency and efficacy, have been used loosely to refer to desired clinical properties. In the current experimental context, however, they are denoted as specific quantities, and therefore are here explicitly defined. By "potency" as used in the current experimental context is meant the EC50 of an antibody or Fc fusion. By "efficacy" as used in the current experimental context is meant the maximal possible effector function of an antibody or Fc fusion at saturating levels. In addition to the substantial enhancements to potency described thus far, FIGS. 27a and 27b show that the Fc variants of the present invention provide greater than 100% enhancements in efficacy over WT trastuzumab and rituximab.

A critical parameter governing the clinical efficacy of anti-cancer antibodies is the expression level of target antigen on the surface of tumor cells. Thus a major clinical advantage of Fc variants that enhance ADCC may be that it enables the targeting of tumors that express lower levels of antigen. In To test this hypothesis, WT and Fc variant trastuzumab antibodies were tested for their ability to mediate ADCC against different cell lines expressing varying levels of the Her2/neu target antigen. ADCC assays were run with various cell lines expressing amplified to low levels of Her2/neu receptor, including Sk-Br-3 ($1\times10^6$ copies), SkOV3 (~$1\times10^5$), OVCAR3(~$1\times10^4$), and MCF-7 (~$3\times10^3$ copies), using the DELFIA EuTDA Cytotoxicity kit (PerkinElmer, Boston, Mass.). Target cells were loaded with BATDA in batch for 25 minutes, washed multiple times with medium and seeded at 10,000 cells per well in 96-well plates. Target cells were opsonized for 15 minutes with various antibodies and concentrations (final conc. ranging from 100 ng/ml to 0.0316 ng/ml in ½ log steps, including no treatment control). Human PBMCs, isolated from buffy-coat and allotyped as homozygous F158/F158 FcγRIIIa were then added to opsonized cells at 25-fold excess and co-cultured at 37° C. for 4 hrs. Thereafter, plates were centrifuged, supernatants were removed and treated with Eu3+ solution, and relative fluorescence units (correlating to the level of cell lysis) were measured using a Packard Fusion™ α-FP HT reader (PerkinElmer, Boston, Mass.). The experiment was carried out in triplicates. FIG. 28 shows the ADCC data comparing WT and Fc variant trastuzumab against the four different Her2/neu$^+$ cell lines. The S239D/I332E (SEQ ID NO:95) and S239D/I332E/A330L (SEQ ID NO:214) variants provide substantial ADCC enhancements over WT trastuzumab at high, moderate, and low expression levels of target antigen. This result suggests that the Fc variants of the present invention may broaden the therapeutic window of anti-cancer antibodies.

Natural killer (NK) cells are a subpopulation of cells present in PBMCs that are thought to play a significant role in ADCC. Select Fc variants were tested in a cell-based ADCC assay in which natural killer (NK) cells rather than PBMCs were used as effector cells. In this assay the release of endogenous lactose dehydrogenase (LDH), rather than EuTDA, was used to monitor cell lysis. FIG. 29 shows that the Fc variants show substantial ADCC enhancement when NK cells are used as effector cells. Furthermore, together with previous assays, the results indicate that the Fc variants of the present invention show substantial ADCC enhancements regardless of the type of effector cell or the detection method used.

Example 8

ADCP of Fc Variants

Another important FcγR-mediated effector function is ADCP. Phagocytosis of target cancer cells may not only lead to the immediate destruction of target cells, but because phagocytosis is a potential mechanism for antigen uptake and processing by antigen presenting cells, enhanced ADCP may also improve the capacity of the antibody or Fc fusion to elicit an adaptive immune response. The ability of the Fc variants of the present invention to mediate ADCP was therefore investigated. Monocytes were isolated from heterozygous V158/F158 FcγRIIIa PBMCs using a Percoll gradient. After one week in culture in the presence of 0.1 ng/ml, differentiated macrophages were detached with EDTA/PBS- and labeled with the lipophilic fluorophore, PKH26, according to the manufacturer's protocol (Sigma, St Louis, Mo.). Sk-Br-3 target cells were labeled with PKH67 (Sigma, St Louis, Mo.), seeded in a 96-well plate at 20,000 cells per well, and treated with designated final concentrations of WT or Fc variant trastuzumab. PKH26-labeled macrophages were then added to the opsonized, labeled Sk-Br-3 cells at 20,000 cells per well and the cells were co-cultured for 18 hrs before processing cells for analysis of dual label flow cytometry. Percent phagocytosis was determined as the number of cells co-labeled with PKH76 and PKH26 (macrophage+Sk-Br-3) over the total number of Sk-Br-3 in the population (phagocytosed+non-phagocytosed) after 10,000 counts. FIG. 30 shows data comparing WT and Fc variant trastuzumab at various antibody concentrations. The results indicate that the S239D/I332E/A330L (SEQ ID NO:214) variant provides a significant enhancement in ADCP over WT trastuzumab.

Example 9

Complement Binding and Activation by Fc Variants

Complement protein C1q binds to a site on Fc that is proximal to the FcγR binding site, and therefore it was prudent to determine whether the Fc variants have maintained their capacity to recruit and activate complement. The AlphaScreen™ assay was used to measure binding of select Fc variants to the complement protein C1q. The assay was carried out with biotinylated WT alemtuzumab antibody attached to streptavidin donor beads as described in Example 2, and using C1q coupled directly to acceptor beads. Binding data of V264I (SEQ ID NO:11), I332E (SEQ ID NO:30), S239E (SEQ ID NO:48), and V264I/I332E (SEQ ID NO:38) rituximab shown in FIG. 31*a* indicate that C1q binding is uncompromised. Cell-based CDC assays were also performed on select Fc variants to investigate whether Fc variants maintain the capacity to activate complement. Alamar Blue was used to monitor lysis of Fc variant and WT rituximab-opsonized WIL2-S lymphoma cells by human serum complement (Quidel, San Diego, Calif.). The data in FIG. 31*b* show that CDC is uncompromised for the Fc variants S239E (SEQ ID NO:48), V264I (SEQ ID NO:11), and V264I/I332E (SEQ ID NO:38) rituximab. In contrast, FIG. 31*c* shows that CDC of the Fc variant S239D/I332E/A330L (SEQ ID NO:214) is completely ablated, whereas the S239D/I332E variant (SEQ ID NO:95) mediates CDC that is comparable to WT rituximab. These results indicate that protein engineering can be used to distinguish between different effector functions. Such control will not only enable the generation of antibodies and Fc fusions with properties tailored for a desired clinical outcome, but also provide a unique set of reagents with which to experimentally investigate effector function biology.

Example 10

Protein A and FcRn Binding by Fc Variants

As discussed, bacterial proteins A and G and the neonatal Fc receptor FcRn bind to the Fc region between the Cγ2 and Cγ3 domains. Protein A is frequently employed for antibody purification, and FcRn plays a key role in antibody pharmacokinetics and transport. It was therefore important to investigate the ability of the Fc variants of the present invention to bind protein A and FcRn. The AlphaScreen™ assay was used to measure binding of select Fc variants to protein A and human FcRn using biotinylated WT alemtuzumab antibody attached to streptavidin donor beads as described in Example 2, and using protein A and FcRn coupled directly to acceptor beads. The binding data are shown in FIG. 32 for protein A and FIG. 33 for FcRn. The results indicate that the Cγ2-Cγ3 hinge region is unaffected by the Fc substitutions, and importantly that the capacity of the Fc variants to bind protein A and FcRn is uncompromised.

Example 11

Capacity of Fc Variants to Bind Mouse FcγRs

Optimization of Fc to nonhuman FcγRs may be useful for experimentally testing Fc variants in animal models. For example, when tested in mice (for example nude mice, SCID mice, xenograft mice, and/or transgenic mice), antibodies and Fc fusions that comprise Fc variants that are optimized for one or more mouse FcγRs may provide valuable information with regard to clinical efficacy, mechanism of action, and the like. In order to evaluate whether the Fc variants of the present invention may be useful in such experiments, affinity of select Fc variants for mouse FcγRIII was measured using the AlphaScreen™ assay. The AlphaScreen™ assay was carried out using biotinylated WT alemtuzumab attached to streptavidin donor beads as described in Example 2, and GST-tagged mouse FcγRIII bound to glutathione chelate acceptor beads, expressed and purified as described in Example 2. These binding data are shown in FIGS. 34a and 34b in the context of alemtuzumab and trastuzumab respectively. Results show that some Fc variants that enhance binding to human FcγRIIIa also enhance binding to mouse FcγRIII. The enhancement of mouse effector function by the Fc variants was investigated by performing the aforementioned cell-based ADCC assays using mouse rather than human PBMC's. FIG. 35 shows that the S239D/I332E/A330L (SEQ ID NO:214) trastuzumab variant provides substantial ADCC enhancement over WT in the presence of mouse immune cells. This result indicates that the Fc variants of the present invention, or other Fc variants that are optimized for nonhuman FcγRs, may find use in experiments that use animal models.

Example 12

Validation of Fc Variants Expressed in CHO Cells

Whereas the Fc variants of the present invention were expressed in 293T cells for screening purposes, large scale production of antibodies is typically carried out by expression in Chinese Hamster Ovary (CHO) cell lines. In order to evaluate the properties of CHO-expressed Fc variants, select Fc variants and WT alemtuzumab were expressed in CHO cells and purified as described in Example 2. FIG. 36 shows AlphaScreen™ data comparing binding of CHO- and 293T-expressed Fc variant and WT alemtuzumab to human V158 FcγRIIIa. The results indicate that the Fc variants of the present invention show comparable FcγR binding enhancements whether expressed in 293T or CHO.

Example 13

Enhancement of Fc Variants in Fucose Minus Strain

Combinations of the Fc variants of the present invention with other Fc modifications are contemplated with the goal of generating novel antibodies or Fc fusions with optimized properties. It may be beneficial to combine the Fc variants of the present invention with other Fc modifications, including modifications that alter effector function or interaction with one or more Fc ligands. Such combination may provide additive, synergistic, or novel properties in antibodies or Fc fusions. For example, a number of methods exist for engineering different glycoforms of Fc that alter effector function. Engineered glycoforms may be generated by a variety of methods known in the art, many of these techniques are based on controlling the level of fucosylated and/or bisecting oligosaccharides that are covalently attached to the Fc region. One method for engineering Fc glycoforms is to express the Fc polypeptide in a cell line that generates altered glycoforms, for example Lec-13 CHO cells. In order to investigate the properties of Fc variants combined with engineered glycoforms, WT and V209 (S239D/I332E/A330L (SEQ ID NO:214)) trastuzumab were expressed in Lec-13 CHO cells and purified as described above. FIG. 37a shows AlphaScreen™ binding data comparing the binding to human V158 FcγRIIIa by WT and V209 trastuzumab expressed in 293T, CHO, and Lec-13 cells. The results show that there is substantial synergy between the engineered glycoforms produced by this cell line and the Fc variants of the present invention. The cell-based ADCC assay, shown in FIG. 37b, supports this result. Together these data indicate that other Fc modifications, particularly engineered glycoforms, may be combined with the Fc variants of the present invention to generate antibodies and Fc fusions with optimized effector functions.

Example 14

Therapeutic Application of Fc Variants

A number of Fc variants described in the present invention have significant potential for improving the therapeutic efficacy of anticancer antibodies. For illustration purposes, a number of Fc variants of the present invention have been incorporated into the sequence of the antibody rituximab. The WT rituximab light chain (SEQ ID NO:3) and heavy chain (SEQ ID NO:4), described in U.S. Pat. No. 5,736,137, are provided in FIGS. 38a and 38b. The improved anti-CD20 antibody sequences (SEQ ID NO:5) are provided in FIG. 38c. The improved anti-CD20 antibody sequences comprise at least non-WT amino acid selected from the group consisting of $X_1$, $X_2$, $X_3$, $X_4$, $X_5$, $X_6$, $X_7$, and $X_8$. These improved anti-CD20 antibody sequences may also comprise a substitution Z, and/or $Z_2$. The use of rituximab here is solely an example, and is not meant to constrain application of the Fc variants to this antibody or any other particular antibody or Fc fusion.

Example 15

A Complete Structure/Function Analysis Fc/Fc Ligand Specificity

It is clear from the results of these experiments that protein engineering is a powerful tool for mining Fc substitutions that significantly alter its biological function and specificity. Given the profound clinical value of antibodies and Fc fusions, the implication is that the protein engineering methods of the present invention can be used to tune the clinical properties of these important biotherapeutics. Such capability, however, demands a more complete understanding of the relationship between the structure and function of Fc and Fc ligands. In addition, the lack of available information on the determinants of Fc/Fc ligand specificity means that it is not possible to actively design Fc variants with all desired properties as target goals. Thus it is likely that, despite the aggressive experimental effort described in the present invention, there are therapeutically useful Fc variants that have not been mined, and biochemical properties of Fc variants that remain undiscovered. Equally important to obtaining new Fc variants for biotherapeutic application is the ability to improve the predictiveness of the design method, thereby permitting variants to be identified even more efficiently. Towards these goals, a more thorough characterization of Fc/Fc ligand biology was carried out. This included: 1) an expansion of the primary screen to include all relevant Fc ligands, and 2) an increase in the number of Fc variants to explore a greater set of substitutions at all relevant Fc positions. Together this broadened approach will enable a more thorough mining of useful Fc variants, provide a greater understanding of Fc/Fc ligand specificity and biology, and provide a greater data set to enable a rigorous quantitative assessment of the predictiveness of the design methods.

variant/Fc ligand affinity is increased by 2-fold or greater, and white indicates that the Fc variant/Fc ligand interaction was not measured or that the data did not allow an accurate determination of affinity. Thus Fc variants are grouped as those that significantly decrease, those that do not substantially alter, and those that significantly increase binding to a given Fc ligand. Visualization of the data in this way provides a structure/function map of Fc, enabling a straightforward interpretation of the results for each position such that useful and interesting variants can be efficiently identified, and such that predictiveness of the design method can be assessed in a practical manner.

TABLE 68

| Variant | SEQ ID NO | Substitution(s) | FcγRI | FcγRIIa | FcγRIIb | FcγRIIc | FcγRIIIa | FcRn | C1q |
|---|---|---|---|---|---|---|---|---|---|
| 111 | SEQ ID NO:116 | L234D | 0.54 | 1.28 | 2.91 | 1.99 | 2.88 | 1.60 | 1.69 |
| 112 | SEQ ID NO:117 | L234E | 0.51 | 0.71 | 1.65 | 1.83 | 2.05 | 0.15 | 1.05 |
| 113 | SEQ ID NO:118 | L234N | 0.11 | 0.07 | 0.90 | 1.11 | 0.20 | 1.64 | 1.02 |
| 114 | SEQ ID NO:119 | L234Q | 0.22 | 1.51 | 2.25 | 2.18 | 0.11 | 2.28 | 0.48 |
| 115 | SEQ ID NO:120 | L234T | 0.18 | 0.95 | 1.19 | 2.00 | 0.25 | 0.99 | 1.73 |
| 116 | SEQ ID NO:121 | L234H | 0.07 | 1.75 | 3.24 | 1.32 | 0.09 | 1.01 | 1.04 |
| 117 | SEQ ID NO:122 | L234Y | 0.36 | 0.99 | 1.06 | 1.82 | 0.51 | 0.78 | 1.15 |
| 118 | SEQ ID NO:123 | L234I | 0.48 | 1.12 | 1.38 | 0.60 | 0.76 | 1.30 | 1.97 |
| 119 | SEQ ID NO:124 | L234V | 0.86 | 1.81 | 3.23 | 0.93 | 1.83 | 1.33 | 1.39 |
| 120 | SEQ ID NO:125 | L234F | 0.13 | 0.09 | 1.20 | 0.35 | 0.25 | 1.02 | 1.94 |
| 121 | SEQ ID NO:126 | L235D | 0.04 | 0.90 | 1.51 | 0.71 | 1.88 | 0.77 | 1.26 |
| 122 | SEQ ID NO:127 | L235S | 0.12 | 0.74 | 1.61 | 0.64 | 0.85 | 0.99 | 1.04 |
| 123 | SEQ ID NO:128 | L235N | 0.03 | 0.77 | 1.56 | 0.76 | 0.34 | 1.10 | 1.46 |
| 124 | SEQ ID NO:129 | L235Q | 0.06 | 0.82 | 2.38 | 0.82 | 0.89 | 0.89 | 1.24 |
| 125 | SEQ ID NO:130 | L235T | 0.10 | 0.63 | 1.19 | 0.72 | 1.40 | 0.93 | 0.92 |
| 126 | SEQ ID NO:131 | L235H | 0.05 | 1.27 | 1.45 | 1.72 | 0.14 | 0.88 | 1.19 |
| 127 | SEQ ID NO:132 | L235Y | 0.09 | 0.79 | 1.43 | 0.61 | 1.09 | 0.58 | 1.50 |
| 128 | SEQ ID NO:133 | L235I | 0.20 | 0.24 | 1.91 | 0.22 | 1.16 | 1.24 | 0.68 |
| 129 | SEQ ID NO:134 | L235V | 0.22 | 8.80 | 3.69 | 2.59 | 0.91 | 2.70 | 1.04 |
| 130 | SEQ ID NO:135 | L235F | 0.09 | 18.03 | 1.78 | 1.31 | 0.79 | 0.92 | 1.26 |

Expansion of the Primary Screen

In order to better characterize the structural and functional determinants of Fc specificity, the primary screen was expanded to include all relevant Fc ligands. Thus all Fc variants are tested in parrallel for binding to FcγRI, FcγRIIa, FcγRIIb, FcγRIIc, FcγRIIIa (Val158 isoform), FcRn, and C1q. The AlphaScreen™ assay was used as described above. All Fc variants were screened in the context of either alemtuzumab or trastuzumab according to Table 62. Table 68 shows an example of the parallel screen for a set of substitutions at Fc positions 234 and 235. In this table, light grey indicates that Fc variant/Fc ligand affinity is 0.5-fold or less than WT, medium grey indicates that Fc variant/Fc ligand affinity is within 0.5-2.0 of WT, dark grey indicates that Fc A number of substitutions at positions 234 and 235 show different specificities for binding to the various Fc ligands. Although the differences in some cases are subtle, the results indicate that it is indeed possible to engineer Fc specificity for different Fc ligands, even at at the FcγR interface where a number of highly homologous receptors bind to the same site. Other Fc variants that provide more distinct affinity differences are presented in Table 69.

TABLE 69

| Variant | SEQ ID NO | Substitution(s) | FcγRI | FcγRIIa | FcγRIIb | FcγRIIc | FcγRIIIa | FcRn | C1q |
|---|---|---|---|---|---|---|---|---|---|
| 107 | SEQ ID NO:112 | A330Y/I332E | 3.14 | 5.40 | 2.90 | 3.84 | 19.63 | 2.65 | 1.15 |
| 109 | SEQ ID NO:114 | A330L/I332E | 6.44 | 1.58 | 1.16 | 1.58 | 24.33 | 5.46 | 1.08 |
| 167 | SEQ ID NO:172 | L328E/I332E | 0.91 | 8.80 | 5.54 | 10.21 | 3.85 | 0.31 | |
| 171 | SEQ ID NO:176 | L328T/I332E | 1.44 | 3.07 | 10.28 | 22.69 | 4.51 | 0.84 | |
| 174 | SEQ ID NO:179 | L328A | 0.80 | 4.24 | 1.08 | 1.11 | 0.64 | 1.06 | |

These data show even more convincingly that it is possible to tune Fc for Fc ligand specificity, often by using very subtle mutational differences. For example, the A330Y/I332E variant (SEQ ID NO:112) enhances binding to all FcγRs, particularly FcγRIIIa, as well as FcRn, while maintaining binding to C1q. However the A330L/I332E variant (SEQ ID NO:114) shows enhanced binding to FcâRI and FcâRIIIa, but has WT affinity for the FcγRII's. In contrast, mutations at L328 provide preferential enhancement of the FcγRII's over FcγRs and FcγRIIIa. In the case of the L328E/I332E variant (SEQ ID NO:172), affinity for all FcγRII's is increased, whereas L328T/I332E (SEQ ID NO:176) provides a clear enhancement specificity profile of FcγRIIc>FcγRIIb>FcγRIIa. In contrast, L328A significantly enhances binding to FcvRIIa, but provides WT affinity for all other FcvR's including FcγRIIb and FcγRIIc. It is clear from these results that very subtle mutational differences can provide substantial differences in specificity. Accordingly, collections of Fc variants such as these will not only enable the generation of antibodies and Fc fusions that have effector function tailored for the desired outcome, but they also provide a unique set of reagents with which to experimentally investigate and characterize effector function biology.

Expansion of the Fc Variant Set

Because of the incomplete information concerning the structural and functional determinants of Fc/Fc ligand interaction, it has not been possible to actively engineer Fc for all desired optimization goals. The distinct specificity differences observed in Tables 68 and 69 to the various FcγRs were due more to the aggressive screening approach of the present invention; these Fc variants were not actively designed with their particular properties as the target goals due to the lack of structural information for binding of Fc to the different FcγRs, as well as the lack of understanding of how the structure and flexibility of the hinge impacts FcγR binding. Indeed the decision to explore a large number and variety of substitutions at these positions 234 and 235 was based on the knowledge that they are near the Fc/FcγR binding site, that mutations at these positions affect FcγR binding, and that according to computational screening calculations a large number and variety of substitutions are permissible at these positions. Overall, the lack of structural information on the determinants of Fc/FcγR specificity, the lack of high-resolution structural information for the Fc/C1q complex, and the inability to account for indirect affects of substitutions on Fc/Fc ligand binding, together make it a certainty that all of the interesting and potentially useful Fc variants will not be explored using the current engineering methods. In order to fully mine useful Fc variants, as well as to obtain a more complete picture of the structural and function determinants of Fc/Fc ligand interaction, the set of Fc variants was expanded to explore a broader set of mutations. All Fc positions at or near the binding sites for FcγR's and C1q, chosen by visual inspection of the available structures and using the information provided by the results of previous Fc variant screening, were saturated such that all substitutions were constructed that have not been tested previously. At Fc positions significantly distal to the FcγR and C1q binding sites, a subset of select substitutions were designed based on predicted energies in previously described computational screening calculations, and based on available data from existing Fc variants. This new set of Fc variants, 576 total, is presented in Table 70.

TABLE 70

| Position | WT | Substitution(s) | Variant |
|---|---|---|---|
| 221 | D | KY | 801-802 |
| 222 | K | EY | 513-514 |

TABLE 70-continued

| Position | WT | Substitution(s) | Variant |
|---|---|---|---|
| 223 | T | EK | 803-804 |
| 224 | H | EY | 805-806 |
| 225 | T | EKW | 807-809 |
| 227 | P | EKYG | 705-708 |
| 228 | P | EKYG | 709-712 |
| 230 | P | EYG | 609-611 |
| 231 | A | EKYPG | 612-616 |
| 232 | P | EKYG | 321-324 |
| 233 | E | NQKRSTHAVLIFMYWG | 617-632 |
| 234 | L | KRSAMWPG | 417-424 |
| 235 | L | EKRAMWPG | 425-432 |
| 236 | G | DENQKRSTHAVLIFMYWP | 713-730 |
| 237 | G | DENQKRSTHVLIFMYWP | 731-747 |
| 238 | P | DENQKRSTHVLIFMYWG | 748-764 |
| 239 | S | QKRVLIMWPG | 325-334 |
| 241 | F | DEY | 335-337 |
| 243 | F | E | 515 |
| 246 | K | DEHY | 810-813 |
| 249 | D | QHY | 814-816 |
| 255 | R | EY | 817-818 |
| 258 | E | SHY | 819-821 |
| 260 | T | DEHY | 822-825 |
| 262 | V | EF | 826-827 |
| 264 | V | DENQKRSHWPG | 433-443 |
| 265 | D | QKRSTHVLIFMYWP | 444-457 |
| 267 | S | EQKRVLIFMYWP | 338-349 |
| 268 | H | DEQKRTVLIFMWPG | 350-363 |
| 269 | E | KSVIMWPG | 765-772 |
| 270 | D | RSLIFMYWPG | 516-525 |
| 271 | P | DENQKRSTHAVLIFMYWG | 526-543 |
| 272 | E | DRTHVLFMWPG | 633-643 |
| 274 | K | DNSHVIFMWPG | 644-654 |
| 275 | F | L | 828 |
| 276 | N | DTHVIFMWPG | 655-664 |
| 278 | Y | DNQRSHVLIMPG | 665-676 |
| 280 | D | KLWPG | 544-548 |
| 281 | G | DKYP | 829-832 |
| 282 | V | EKYPG | 833-837 |
| 283 | E | KHLYPG | 838-843 |

TABLE 70-continued

| Position | WT | Substitution(s) | Variant |
|---|---|---|---|
| 284 | V | ENTLY | 844-848 |
| 285 | H | DEQKYW | 773-778 |
| 286 | N | EYPG | 779-782 |
| 288 | K | DEY | 783-785 |
| 290 | K | DNHLW | 549-553 |
| 291 | P | DEQTHIG | 849-855 |
| 292 | R | DETY | 786-789 |
| 293 | E | NRSTHVLIFMYWPG | 554-567 |
| 294 | E | KRSTHVLIFMYWPG | 568-581 |
| 295 | Q | DENRSTHVIFMYWPG | 582-596 |
| 296 | Y | KRAVMG | 597-602 |
| 297* | N | QKRTHVLIFMYWPG | 856-869 |
| 298 | S | DEQKRIFMYW | 364-373 |
| 299 | T | DENQKRLFMYWPG | 374-386 |
| 300 | Y | DENQKRSTHAVMWPG | 387-401 |
| 301 | R | DEHY | 870-873 |
| 303 | V | DEY | 874-876 |
| 304 | S | DNTHL | 877-881 |
| 305 | V | ETY | 882-884 |
| 317 | K | EQ | 885-886 |
| 318 | E | QHLY | 887-890 |
| 320 | K | NSHVLFYWPG | 677-686 |
| 322 | K | DSVIFYWPG | 687-695 |
| 324 | S | HFMWPG | 603-608 |
| 325 | N | KRSFMYWPG | 696-704 |
| 326 | K | P | 458 |
| 327 | A | EKRHVIFMYWP | 459-469 |
| 328 | L | DQKRSTVIYWPG | 470-481 |
| 329 | P | DENQKRSTHVLIMYWG | 482-497 |
| 330 | A | ENTPG | 402-406 |
| 331 | P | DQRTLIFMYW | 498-507 |
| 332 | I | KRSVLFMWPG | 407-416 |
| 333 | E | LFMP | 508-511 |
| 334 | K | P | 512 |
| 335 | T | NSHVLIFMWPG | 790-800 |
| 336 | I | EKY | 891-893 |
| 337 | S | ENH | 894-896 |

*Substitutions at 297 were made in the context of S239D/I332E

All references are herein expressly incorporated by reference.

Whereas particular embodiments of the invention have been described above for purposes of illustration, it will be appreciated by those skilled in the art that numerous variations of the details may be made without departing from the invention as described in the appended claims.

SEQUENCE LISTING (308 sequences)

SEQ ID NO: 1 - protein, 451 aa, Homo sapiens
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - protein, 213 aa, Homo sapiens
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 451 aa, Homo sapiens
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 451 aa, Homo sapiens
  misc_feature (243)..(243): Xaa can be one of the following amino acids: serine, aspartic acid, glutamic acid, asparagine, glutamine or threonine
  misc_feature (244)..(244): Xaa can be one of the following amino acids: valine, isoleucine or methionine
  misc_feature (268)..(268): Xaa can be one of the following amino acids: valine, isoleucine, threonine or tyrosine
  misc_feature (276)..(276): Xaa can be one of the following amino acids: glutamic acid or tyrosine
  misc_feature (278)..(278): Xaa can be one of the following amino acids: lysine or glutamic acid
  misc_feature (301)..(301): Xaa can be one of the following amino acids: asparagine or aspartic acid
  misc_feature (302)..(302): Xaa can be one of the following amino acids: serine or alanine
  misc_feature (330)..(330): Xaa can be one of the following amino acids: lysine, glutamic acid or threonine
  misc_feature (334)..(334): Xaa can be one of the following amino acids: alanine, tyrosine, leucine or isoleucine
  misc_feature (336)..(336): Xaa can be one of the following amino acids: isoleucine, aspartic acid, glutamic acid, asparagine or glutamine
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPXXFLFPPKPKDTLMISRTPEVTCVVXDVSHEDPXVXFNWYVDGVEVHNAKTKPREEQYXXTYRVVSVLTVLHQDWLNGKEYKCKVSNXALPXPXEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - protein, 5 aa, Artificial
  synthetic
GSGGS

SEQ ID NO: 7 - protein, 5 aa, Artificial
  synthetic
GGGGS

SEQ ID NO: 8 - protein, 4 aa, Artificial
  synthetic
GGGS

SEQ ID NO: 9 - protein, 227 aa, Artificial
  synthetic
DKTHTCPPCPAPELLGGPSVFLFPPKPKDTLMISRTPEVTCVVADVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10 - protein, 227 aa, Artificial
  synthetic
DKTHTCPPCPAPELLGGPSVFLFPPKPKDTLMISRTPEVTCVVLDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11 - protein, 227 aa, Artificial
  synthetic
DKTHTCPPCPAPELLGGPSVFLFPPKPKDTLMISRTPEVTCVVIDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 227 aa, Artificial
  synthetic
DKTHTCPPCPAPELLGGPSVWLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - protein, 227 aa, Artificial
  synthetic
DKTHTCPPCPAPELLGGPSVLLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 14 - protein, 227 aa, Artificial
  synthetic
DKTHTCPPCPAPELLGGPSVFLWPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 15 - protein, 227 aa, Artificial
  synthetic
DKTHTCPPCPAPELLGGPSVFLLPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - protein, 227 aa, Artificial
  synthetic
DKTHTCPPCPAPELLGGPSVLLLPPKPKDTLMISRTPEVTCIVIDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17 - protein, 227 aa, Artificial
  synthetic
DKTHTCPPCPAPELLGGPSVWLWPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 227 aa, Artificial
  synthetic
DKTHTCPPCPAPELLGGPSVWLWPPKPKDTLMISRTPEVTCAVADVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - protein, 227 aa, Artificial
  synthetic
DKTHTCPPCPAPELLGGPSVLLFPPKPKDTLMISRTPEVTCIVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - protein, 227 aa, Artificial
  synthetic
DKTHTCPPCPAPELLGGPSVFLLPPKPKDTLMISRTPEVTCVVIDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 21 - protein, 227 aa, Artificial
  synthetic
DKTHTCPPCPAPELLGGPSVFLLPPKPKDTLMISRTPEVTCIVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 227 aa, Artificial
  synthetic
DKTHTCPPCPAPELLGGPSVYLYPPKPKDTLMISRTPEVTCTVTDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 227 aa, Artificial
  synthetic
DKTHTCPPCPAPELLGGPSVELRPPKPKDTLMISRTPEVTCEVRDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 227 aa, Artificial
  synthetic
DKTHTCPPCPAPELLGGPSVELQPPKPKDTLMISRTPEVTCTVEDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 25 - protein, 227 aa, Artificial
  synthetic
DKTHTCPPCPAPELLGGPSVRLQPPKPKDTLMISRTPEVTCTVRDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 227 aa, Artificial
  synthetic
DKTHTCPPCPAPELLGGPSVELYPPKPKDTLMISRTPEVTCTVRDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAMPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAEPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAMPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 227 aa, Artificial
  synthetic
DKTHTCPPCPAPELLGGPSVFLFHPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 227 aa, Artificial
  synthetic
DKTHTCPPCPAPELLGGPSVFLFPAKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 227 aa, Artificial
  synthetic
DKTHTCPPCPAPELLGGPSVFLFPPKVKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDFLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 227 aa, Artificial
  synthetic
DKTHTCPPCPAPELLGGPSVFLFHAKVKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 227 aa, Artificial
  synthetic
DKTHTCPPCPAPELLGGPSVFLFPPKGKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 227 aa, Artificial
  synthetic
DKTHTCPPCPAPELLGGPSVFLFPPKPKDTLMISRTPEVTCVVIDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 227 aa, Artificial
  synthetic
DKTHTCPPCPAPELLGGPSVELRPPKPKDTLMISRTPEVTCEVRDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 227 aa, Artificial
  synthetic
DKTHTCPPCPAPELLGGPSVELQPPKPKDTLMISRTPEVTCTVEDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 227 aa, Artificial
  synthetic
DKTHTCPPCPAPELLGGPSVRLQPPKPKDTLMISRTPEVTCTVRDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 227 aa, Artificial
  synthetic
DKTHTCPPCPAPELLGGPSVELYPPKPKDTLMISRTPEVTCTVRDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 43 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 45 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 46 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 227 aa, Artificial
  synthetic
DKTHTCPPCPAPELLGGPQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 48 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 227 aa, Artificial
  synthetic
DKTHTCPPCPAPELLGGPSVFLFPPKPKDTLMISRTPEVTCVVVGVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 227 aa, Artificial
  synthetic
DKTHTCPPCPAPELLGGPSVFLFPPKPKDTLMISRTPEVTCVVVNVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 51 - protein, 227 aa, Artificial
  synthetic
DKTHTCPPCPAPELLGGPEVFLFPPKPKDTLMISRTPEVTCVVVGVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 52 - protein, 227 aa, Artificial
  synthetic
DKTHTCPPCPAPELLGGPEVFLFPPKPKDTLMISRTPEVTCVVVNVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 227 aa, Artificial
  synthetic
DKTHTCPPCPAPELLGGPEVFLFPPKPKDTLMISRTPEVTCVVVQVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQENSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQQNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNTTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNNTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSIYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKSLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKNLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 227 aa, Artificial
  synthetic
DKTHTCPPCPAPELLGGPSVFLFPPKPKDTLMISRTPEVTCVVVDVQHEDPEVKFNWYVDGVEVHNAKTKPREEQYNSTYRVVSVLTVLHQDWLNGKEYKCKVSNKSLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 227 aa, Artificial
  synthetic
DKTHTCPPCPAPELLGGPSVFLFPPKPKDTLMISRTPEVTCVVVDVLHEDPEVKFNWYVDGVEVHNAKTKPREEQYNSTYRVVSVLTVLHQDWLNGKEYKCKVSNKSLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKLLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALFAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPYPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPDEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYSSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYSSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYESTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 227 aa, Artificial
  synthetic
DKTHTCPPCPAPELLGGPSVFLFPPKPKDTLMISRTPEVTCVVVYVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 227 aa, Artificial
  synthetic
DKTHTCPPCPAPELLGGPSVFLFPPKPKDTLMISRTPEVTCVVVYVSHEDPEVKFNWYVDGVEVHNAKTKPREEQYDSLYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 227 aa, Artificial
  synthetic
DKTHTCPPCPAPELLGGPSVFLFPPKPKDTLMISRTPEVTCVVVFVSHEDPEVKFNWYVDGVEVHNAKTKPREEQYESTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAIPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAQPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPNEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPQEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 227 aa, Artificial
  synthetic
DKTHTCPPCPAPELLGGPSVFLFPPKPKDTLMISRTPEVTCVVTDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 227 aa, Artificial
  synthetic
DKTHTCPPCPAPELLGGPSVFLFPPKPKDTLMISRTPEVTCVVFDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 227 aa, Artificial
  synthetic
DKTHTCPPCPAPELLGGPSIFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 227 aa, Artificial
  synthetic
DKTHTCPPCPAPELLGGPSVFLFPPKPKDTLMISRTPEVTCVIVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 227 aa, Artificial
  synthetic
DKTHTCPPCPAPELLGGPSVFLFPPKPKDTLMISRTPEVTCVVVDISHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSAYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSSYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSVYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSQKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSLKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSIKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 227 aa, Artificial
  synthetic
DKTHTCPPCPAPELLGGPFVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPDEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPNEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPQEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPDEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPNEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYNSTYRVVSVLTVLHQDWLNGKEYKCKVSNKALPAPQEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPAPDEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPAPNEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPAPQEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 227 aa, Artificial
  synthetic
DKTHTCPPCPAPELLGGPQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPDEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 227 aa, Artificial
  synthetic
DKTHTCPPCPAPELLGGPQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPNEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 227 aa, Artificial
  synthetic
DKTHTCPPCPAPELLGGPQVFLFPPKPKDTLMISRTPEVTCVVVDVSHEDPEVKFNWYVDGVEVHNAKTKPREEQYNSTYRVVSVLTVLHQDWLNGKEYKCKVSNKALPAPQEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNEALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQDNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQNNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 227 aa, Artificial
  synthetic
DKTHTCPPCPAPELLGGPSVYLYPPKPKDTLMISRTPEVTCTVTDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 227 aa, Artificial
  synthetic
DKTHTCPPCPAPELLGGPSVFLFPPKPKDTLMISRTPEVTCVVIDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 227 aa, Artificial
  synthetic
DKTHTCPPCPAPELLGGPSVFLFPPKPKDTLMISRTPEVTCVVIDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 227 aa, Artificial
  synthetic
DKTHTCPPCPAPEDLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 227 aa, Artificial
  synthetic
DKTHTCPPCPAPEELGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 227 aa, Artificial
  synthetic
DKTHTCPPCPAPENLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 227 aa, Artificial
  synthetic
DKTHTCPPCPAPEQLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 227 aa, Artificial
  synthetic
DKTHTCPPCPAPETLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 227 aa, Artificial
  synthetic
DKTHTCPPCPAPEHLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 227 aa, Artificial
  synthetic
DKTHTCPPCPAPEYLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 227 aa, Artificial
  synthetic
DKTHTCPPCPAPEILGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 227 aa, Artificial
  synthetic
DKTHTCPPCPAPEVLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 227 aa, Artificial
  synthetic
DKTHTCPPCPAPEFLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 227 aa, Artificial
  synthetic
DKTHTCPPCPAPELDGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 227 aa, Artificial
  synthetic
DKTHTCPPCPAPELSGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 227 aa, Artificial
  synthetic
DKTHTCPPCPAPELNGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 227 aa, Artificial
  synthetic
DKTHTCPPCPAPELQGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 227 aa, Artificial
  synthetic
DKTHTCPPCPAPELTGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 227 aa, Artificial
  synthetic
DKTHTCPPCPAPELHGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 227 aa, Artificial
  synthetic
DKTHTCPPCPAPELYGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 227 aa, Artificial
  synthetic
DKTHTCPPCPAPELIGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 227 aa, Artificial
  synthetic
DKTHTCPPCPAPELVGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 227 aa, Artificial
  synthetic
DKTHTCPPCPAPELFGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 227 aa, Artificial
  synthetic
DKTHTCPPCPAPELLGGPTVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 227 aa, Artificial
  synthetic
DKTHTCPPCPAPELLGGPHVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 227 aa, Artificial
  synthetic
DKTHTCPPCPAPELLGGPYVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 227 aa, Artificial
  synthetic
DKTHTCPPCPAPELLGGPSAFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 227 aa, Artificial
  synthetic
DKTHTCPPCPAPELLGGPSTFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 227 aa, Artificial
  synthetic
DKTHTCPPCPAPELLGGPSMFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - protein, 227 aa, Artificial
  synthetic
DKTHTCPPCPAPELLGGPSVFLFPPKPKDTLMISRTPEVTCVAVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 227 aa, Artificial
  synthetic
DKTHTCPPCPAPELLGGPSVFLFPPKPKDTLMISRTPEVTCVTVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 144 - protein, 227 aa, Artificial
  synthetic
DKTHTCPPCPAPELLGGPSVFLFPPKPKDTLMISRTPEVTCVMVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 227 aa, Artificial
  synthetic
DKTHTCPPCPAPELLGGPSVFLFPPKPKDTLMISRTPEVTCVVMDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 227 aa, Artificial
  synthetic
DKTHTCPPCPAPELLGGPSVFLFPPKPKDTLMISRTPEVTCVVYDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 147 - protein, 227 aa, Artificial
  synthetic
DKTHTCPPCPAPELLGGPSVFLFPPKPKDTLMISRTPEVTCVVVDASHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 148 - protein, 227 aa, Artificial
  synthetic
DKTHTCPPCPAPELLGGPSVFLFPPKPKDTLMISRTPEVTCVVVDTSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 227 aa, Artificial
  synthetic
DKTHTCPPCPAPELLGGPSVFLFPPKPKDTLMISRTPEVTCVVVDMSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 227 aa, Artificial
  synthetic
DKTHTCPPCPAPELLGGPSVFLFPPKPKDTLMISRTPEVTCVVVDVSHHDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 227 aa, Artificial
  synthetic
DKTHTCPPCPAPELLGGPSVFLFPPKPKDTLMISRTPEVTCVVVDVSHYDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 227 aa, Artificial
  synthetic
DKTHTCPPCPAPELLGGPSVFLFPPKPKDTLMISRTPEVTCVVVDVSHFDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 227 aa, Artificial
  synthetic
DKTHTCPPCPAPELLGGPSVFLFPPKPKDTLMISRTPEVTCVVVDVSHRDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQSNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQTNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQLNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQINSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNHTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSHYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPIPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPFPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPRPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPHPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSDKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSEKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSAKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSTKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSVKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSHKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKADPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAEPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKANPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 227 aa, Artificial; identical to SEQ ID NO: 77
  synthetic

SEQ ID NO: 175 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAVPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKATPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAHPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 227 aa, Artificial; identical to SEQ ID NO: 76
  synthetic

SEQ ID NO: 179 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAAPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPTEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPHEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPYEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPAEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 227 aa, Artificial
  synthetic
DKTHTCPPCPAPELLGGPEVFLFPPKPKDTLMISRTPEVTCVVIDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 227 aa, Artificial
  synthetic
DKTHTCPPCPAPELLGGPQVFLFPPKPKDTLMISRTPEVTCVVIDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 227 aa, Artificial
  synthetic
DKTHTCPPCPAPELLGGPEVFLFPPKPKDTLMISRTPEVTCVVIDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 227 aa, Artificial
  synthetic
DKTHTCPPCPAPELLGGPEVFLFPPKPKDTLMISRTPEVTCVVIDVSHEDPEVKFNWYVDGVEVHNAKTKPREEQYNATYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 227 aa, Artificial
  synthetic
DKTHTCPPCPAPELLGGPEVFLFPPKPKDTLMISRTPEVTCVVVDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 227 aa, Artificial
  synthetic
DKTHTCPPCPAPELLGGPDVFLFPPKPKDTLMISRTPEVTCVVVVVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 227 aa, Artificial
  synthetic
DKTHTCPPCPAPELLGGPDVFLFPPKPKDTLMISRTPEVTCVVVIVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 227 aa, Artificial
  synthetic
DKTHTCPPCPAPELLGGPDVFLFPPKPKDTLMISRTPEVTCVVVLVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 227 aa, Artificial
  synthetic
DKTHTCPPCPAPELLGGPDVFLFPPKPKDTLMISRTPEVTCVVVFVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 227 aa, Artificial
  synthetic
DKTHTCPPCPAPELLGGPDVFLFPPKPKDTLMISRTPEVTCVVVYVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 227 aa, Artificial
  synthetic
DKTHTCPPCPAPELLGGPDVFLFPPKPKDTLMISRTPEVTCVVVHVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 227 aa, Artificial
  synthetic
DKTHTCPPCPAPELLGGPDVFLFPPKPKDTLMISRTPEVTCVVVTVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 227 aa, Artificial
  synthetic
DKTHTCPPCPAPELLGGPSVFLFPPKPKDTLMISRTPEVTCVVEDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQDDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQEDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQNDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQQDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQHDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQTDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSVYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSIYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSLYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSFYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSHYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSEYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYDATYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 227 aa, Artificial
  synthetic
DKTHTCPPCPAPELLGGPSVFLFPPKPKDTLMISRTPEVTCVVIDVSHEDPEVKFNWYVDGVEVHNAKTKPREEQYNATYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 227 aa, Artificial
  synthetic
DKTHTCPPCPAPELLGGPNVFLFPPKPKDTLMISRTPEVTCVVVDVSHEDPEVKFNWYVDGVEVHNAKTKPREEQYNATYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 227 aa, Artificial
  synthetic
DKTHTCPPCPAPELLGGPDVFLFPPKPKDTLMISRTPEVTCVVIDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 227 aa, Artificial
  synthetic
DKTHTCPPCPAPELLGGPDVFLFPPKPKDTLMISRTPEVTCVVIDVSHEDPEVKFNWYVDGVEVHNAKTKPREEQYNATYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 227 aa, Artificial
  synthetic
DKTHTCPPCPAPELLGGPDVFLFPPKPKDTLMISRTPEVTCVVIDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKANPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAHPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 224 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPIPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 225 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYDSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 226 - protein, 227 aa, Artificial
  synthetic
DKTHTCPPCAAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 227 aa, Artificial
  synthetic
DKTHTCPPCPAPDLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - protein, 227 aa, Artificial
  synthetic
DKTHTCPPCAAPDLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 227 aa, Artificial
  synthetic
DKTHTCPPCAAPDLLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 230 - protein, 227 aa, Artificial
  synthetic
DKTHTCPPCPAPELLGGPSVFLFPPKPKDTLMISRTPEVTCVVVDVTHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 231 - protein, 227 aa, Artificial
  synthetic
DKTHTCPPCPAPELLGGPSVFLFPPKPKDTLMISRTPEVTCVVVDVHHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 232 - protein, 227 aa, Artificial
  synthetic
DKTHTCPPCPAPELLGGPSVFLFPPKPKDTLMISRTPEVTCVVVDVDHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 227 aa, Artificial
  synthetic
DKTHTCPPCPAPELLGGPSVFLFPPKPKDTLMISRTPEVTCVVVDVNHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 227 aa, Artificial
  synthetic
DKTHTCPPCPAPELLGGPSVFLFPPKPKDTLMISRTPEVTCVVVDVSHTDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - protein, 227 aa, Artificial
  synthetic
DKTHTCPPCPAPELLGGPSVFLFPPKPKDTLMISRTPEVTCVVVDVSHLDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 227 aa, Artificial
  synthetic
DKTHTCPPCPAPELLGGPSVFLFPPKPKDTLMISRTPEVTCVVVDVSHNDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 227 aa, Artificial
  synthetic
DKTHTCPPCPAPELLGGPSVFLFPPKPKDTLMISRTPEVTCVVVDVSHEQPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 227 aa, Artificial
  synthetic
DKTHTCPPCPAPELLGGPSVFLFPPKPKDTLMISRTPEVTCVVVDVSHETPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 227 aa, Artificial
  synthetic
DKTHTCPPCPAPELLGGPSVFLFPPKPKDTLMISRTPEVTCVVVDVSHEHPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 227 aa, Artificial
  synthetic
DKTHTCPPCPAPELLGGPSVFLFPPKPKDTLMISRTPEVTCVVVDVSHEDPSVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 227 aa, Artificial
  synthetic
DKTHTCPPCPAPELLGGPSVFLFPPKPKDTLMISRTPEVTCVVVDVSHEDPKVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 227 aa, Artificial
  synthetic
DKTHTCPPCPAPELLGGPSVFLFPPKPKDTLMISRTPEVTCVVVDVSHEDPIVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 227 aa, Artificial
  synthetic
DKTHTCPPCPAPELLGGPSVFLFPPKPKDTLMISRTPEVTCVVVDVSHEDPYVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 227 aa, Artificial
  synthetic
DKTHTCPPCPAPELLGGPSVFLFPPKPKDTLMISRTPEVTCVVVDVSHEDPEIKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 227 aa, Artificial
  synthetic
DKTHTCPPCPAPELLGGPSVFLFPPKPKDTLMISRTPEVTCVVVDVSHEDPEVTFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 227 aa, Artificial
  synthetic
DKTHTCPPCPAPELLGGPSVFLFPPKPKDTLMISRTPEVTCVVVDVSHEDPEVEFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - protein, 227 aa, Artificial
  synthetic
DKTHTCPPCPAPELLGGPSVFLFPPKPKDTLMISRTPEVTCVVVDVSHEDPEVRFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 248 - protein, 227 aa, Artificial
  synthetic
DKTHTCPPCPAPELLGGPSVFLFPPKPKDTLMISRTPEVTCVVVDVSHEDPEVLFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - protein, 227 aa, Artificial
  synthetic
DKTHTCPPCPAPELLGGPSVFLFPPKPKDTLMISRTPEVTCVVVDVSHEDPEVYFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 250 - protein, 227 aa, Artificial
  synthetic
DKTHTCPPCPAPELLGGPSVFLFPPKPKDTLMISRTPEVTCVVVDVSHEDPEVKWNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 227 aa, Artificial
  synthetic
DKTHTCPPCPAPELLGGPSVFLFPPKPKDTLMISRTPEVTCVVVDVSHEDPEVKFSWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 227 aa, Artificial
  synthetic
DKTHTCPPCPAPELLGGPSVFLFPPKPKDTLMISRTPEVTCVVVDVSHEDPEVKFEWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 227 aa, Artificial
  synthetic
DKTHTCPPCPAPELLGGPSVFLFPPKPKDTLMISRTPEVTCVVVDVSHEDPEVKFRWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 227 aa, Artificial
  synthetic
DKTHTCPPCPAPELLGGPSVFLFPPKPKDTLMISRTPEVTCVVVDVSHEDPEVKFLWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 227 aa, Artificial
  synthetic
DKTHTCPPCPAPELLGGPSVFLFPPKPKDTLMISRTPEVTCVVVDVSHEDPEVKFYWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 227 aa, Artificial
  synthetic
DKTHTCPPCPAPELLGGPSVFLFPPKPKDTLMISRTPEVTCVVVDVSHEDPEVKFNWTVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 227 aa, Artificial
  synthetic
DKTHTCPPCPAPELLGGPSVFLFPPKPKDTLMISRTPEVTCVVVDVSHEDPEVKFNWEVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 258 - protein, 227 aa, Artificial
  synthetic
DKTHTCPPCPAPELLGGPSVFLFPPKPKDTLMISRTPEVTCVVVDVSHEDPEVKFNWKVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 259 - protein, 227 aa, Artificial
  synthetic
DKTHTCPPCPAPELLGGPSVFLFPPKPKDTLMISRTPEVTCVVVDVSHEDPEVKFNWWVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 260 - protein, 227 aa, Artificial
  synthetic
DKTHTCPPCPAPELLGGPSVFLFPPKPKDTLMISRTPEVTCVVVDVSHEDPEVKFNWYVDGVRVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRIVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 262 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKRYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYTCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 264 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYDCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYICKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCTVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCHVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 268 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKISNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVTNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVDNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 271 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVRNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVINKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVVNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVLNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVYNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNLALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNIALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNTALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKDLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 280 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKTLPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPSPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPWPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPMPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAVIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAHIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPITKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIHKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIIKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIYKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEITISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIETTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEFTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKDISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKRISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 227 aa, Artificial
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKYISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 227 aa, Artificial
  synthetic
DKTHTCPPCPAPEIDGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 227 aa, Artificial
  synthetic
DKTHTCPPCPAPELLGGPSIFLFPPKPKDTLMISRTPEVTCVVVDISHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 227 aa, Artificial
  synthetic
DKTHTCPPCPAPEILGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 227 aa, Artificial
  synthetic
DKTHTCPPCPAPELDGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 227 aa, Artificial
  synthetic
DKTHTCPPCPAPELLGGPDIFLFPPKPKDTLMISRTPEVTCVVVDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 227 aa, Artificial
  synthetic
DKTHTCPPCPAPELLGGPDVFLFPPKPKDTLMISRTPEVTCVVTDVSHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 302 - protein, 227 aa, Artificial
  synthetic
DKTHTCPPCPAPELLGGPDVFLFPPKPKDTLMISRTPEVTCVVVDISHEDPEVKFNWYVDGVEVHNAKTKPREEQYNSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 303 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNEALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 304 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNTALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 305 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYDSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 227 aa, Artificial
  synthetic
DKTHTCPPCPAPELLGGPDVSLHPPKPKDTLMISRTPEVTCTVTDVSHEDPEVKFNWYVDGVEVHNAKTKPREEQYDSTYRVVSVLTVLHQDWLNGKEYKCKVSNKALPYPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 307 - protein, 227 aa, Artificial
  synthetic
DKTHTCPPCPAPELDGGPDVFLFPPKPKDTLMISRTPEVTCVVVDVSHEDPEVKFNWYVDGVEVHNAKTKPREEQYDSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 308 - protein, 227 aa, Artificial
  synthetic
DKTHTCPPCPAPELLGGPDVFLFPPKPKDTLMISRTPEVTCVVVDVSHEDPEVKFNWYVDGVEVHNAKTKPREEQYDSTYRVVSVLTVLHQDWLNGKEYKCKVSNEALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

We claim

1. A protein comprising an Fc variant of a parent Fc polypeptide, wherein said Fc variant comprises an amino acid modification at position 332, wherein numbering is according to the EU index, and wherein said Fc variant comprises an engineered glycoform.

2. A protein comprising an Fc variant of a parent Fc polypeptide, wherein said Fc variant comprises an amino acid modification selected from the group consisting of 332A, 332D, 332E, 332F, 332G, 332H, 332K, 332L, 332M, 332N, 332P, 332Q, 332R, 332S, 332T, 332V, 332W and 332Y, wherein numbering is according to the EU index, and wherein said Fc variant comprises an engineered glycoform.

3. A protein comprising an Fc variant of a parent Fc polypeptide, wherein said Fc variant comprises an amino acid modification at position 332, wherein said Fc variant further comprises an amino acid substitution at a position selected from the group consisting of 221, 222, 224, 227, 228, 230, 231, 223, 233, 234, 235, 236, 237, 238, 239, 240, 241, 243, 244, 245, 246, 247, 249, 250, 258, 262, 263, 264, 265, 266, 268, 269, 270, 271, 272, 273, 274, 275, 276, 278, 280, 281, 283, 285, 286, 288, 290, 291, 293, 294, 295, 296, 297, 298, 299, 300, 302, 313, 317, 318, 320, 322, 323, 324, 325, 326, 327, 328, 329, 330, 331, 333, 334, 335 336 and 428, wherein numbering is according to the EU index, and wherein said Fc variant comprises an engineered glycoform.

4. A protein according to claim 1, wherein said Fc variant further comprises an amino acid modification at a position selected from the group consisting of 235A, 235D, 235E, 235F, 235G, 235H, 235I, 235K, 235M, 235N, 235P, 235Q, 235R, 235S, 235T, 235V, 235W, 235Y, 236A, 236D, 236E, 236F, 236H, 236I, 236K, 236L, 236M, 236N, 236P, 236Q, 236R, 236S, 236T, 236V, 236W, 236Y, 239D, 239E, 239F, 239G, 239H, 239I, 239K, 239L, 239M, 239N, 239P, 239Q, 239R, 239T, 239V, 239W, 239Y, 243E, 243H, 243L, 243Q, 243R, 243W, 243Y, 267D, 267E, 267F, 267H, 267I, 267K, 267L, 267M, 267N, 267P, 267Q, 267R, 267T, 267V, 267W, 267Y, 268D, 268E, 268F, 268G, 268I, 268K, 268L, 268M, 268P, 268Q, 268R, 268T, 268V, 268W, 325A, 325D, 325E, 325F, 325G, 325H, 325I, 325K, 325L, 325M, 325P, 325Q, 325R, 325S, 325T, 325V, 325W, 325Y, 328A, 328D, 328E, 328F, 328G, 328H, 328I, 328K, 328M, 328N, 328P, 328Q, 328R, 328S, 328T, 328V, 328W, 328Y, 330E, 330F, 330G, 330H, 330I, 330L, 330M, 330N, 330P, 330R, 330S, 330T, 330V, 330W, and 330Y, and wherein numbering is according to the EU index.

5. A protein comprising an Fc variant of a parent Fc polypeptide, wherein said Fc variant comprises an amino acid modification at position 332, wherein said Fc variant has greater affinity for an Fc gamma receptor relative to said parent Fc polypeptide, wherein numbering is according to the EU index, and wherein said Fc variant comprises an engineered glycoform.

6. A protein according to any of claims 1-4 or 5, wherein said protein is an antibody.

7. An antibody according to claim 6 wherein said antibody is selected from the group consisting of a human antibody, a humanized antibody, and a monoclonal antibody.

8. A protein according to any of claims 1, 2 or 4 further comprising a modification at position 297.

9. A protein according to any of claims 1-4, wherein said engineered glycoform is a reduced level of fucose relative to a native human lgG.

10. A protein according to claim 9, wherein said protein has been produced in cells wherein a glycosylation enzyme has been modified.

11. A protein according to claim 10, wherein said protein has been produced in lec13 CHO cells or YB2/0 cells.

12. A protein according to claim 10, wherein said glycosylation enzyme is α 1,6-fucosyltranserase (FUT8) or β1-4-N-acetylglucosaminyltransferase III (GnTIII).

13. A protein according to any of claims 1-4 wherein said protein has specificity for a target antigen selected from the group consisting of CD19, CD20, CD22, CD30, CD33, CD40, CD40L, CD52, Her2/neu, EGFR, EpCAM, MUC1, GD3, CEA, CA 125, HLA-DR, TNFaipha, MUC18, prostate specific membrane antigen (PMSA) and VEGF.

14. A composition comprising the protein according to any of claims 1-4 further comprising a pharmaceuticaily acceptable carrier.

15. A protein according to claim 3, wherein said protein comprises a modification at position 297.

\* \* \* \* \*